US010881726B2

(12) United States Patent
Houghton et al.

(10) Patent No.: US 10,881,726 B2
(45) Date of Patent: Jan. 5, 2021

(54) HEPATITIS C VIRUS IMMUNOGENIC COMPOSITIONS AND METHODS OF USE THEREOF

(71) Applicants: The Governors of the University of Alberta, Edmonton (CA); Helmholtz Center for Infection Research, Braunschweig (DE)

(72) Inventors: Michael Houghton, Danville, CA (US); Abdolamir Landi, Edmonton (CA); Carlos A. Guzman, Braunschweig (DE); Thomas Ebensen, Braunschweig (DE); Darren Hockman, Edmonton (CA); John L. Law, Edmonton (CA); Michael Logan, Edmonton (CA)

(73) Assignees: The Governors of the University of Alberta, Edmonton (CA); Helmholtz Center for Infection Research, Braunschweig (DE)

( * ) Notice: Subject to any disclaimer, the term of this patent is extended or adjusted under 35 U.S.C. 154(b) by 0 days.

(21) Appl. No.: 16/336,732

(22) PCT Filed: Oct. 5, 2017

(86) PCT No.: PCT/CA2017/051192
§ 371 (c)(1),
(2) Date: Mar. 26, 2019

(87) PCT Pub. No.: WO2018/068132
PCT Pub. Date: Apr. 19, 2018

(65) Prior Publication Data
US 2019/0231867 A1      Aug. 1, 2019

Related U.S. Application Data

(60) Provisional application No. 62/406,770, filed on Oct. 11, 2016.

(51) Int. Cl.
| | | |
|---|---|---|
| A61K 39/00 | (2006.01) |
| A61K 39/12 | (2006.01) |
| A61K 39/39 | (2006.01) |
| A61K 31/675 | (2006.01) |
| A61K 39/095 | (2006.01) |
| A61K 39/29 | (2006.01) |
| A61P 31/14 | (2006.01) |
| A61P 37/04 | (2006.01) |
| C07K 14/005 | (2006.01) |
| C01F 11/02 | (2006.01) |
| C07D 323/00 | (2006.01) |
| C07K 14/18 | (2006.01) |
| C07K 14/28 | (2006.01) |
| C07K 14/33 | (2006.01) |
| C07K 14/34 | (2006.01) |
| C12N 15/86 | (2006.01) |

(52) U.S. Cl.
CPC .............. *A61K 39/29* (2013.01); *A61K 39/12* (2013.01); *A61K 39/39* (2013.01); *A61P 31/14* (2018.01); *A61P 37/04* (2018.01); *C01F 11/02* (2013.01); *C07D 323/00* (2013.01); *C07K 14/005* (2013.01); *C07K 14/18* (2013.01); *C07K 14/28* (2013.01); *C07K 14/33* (2013.01); *C07K 14/34* (2013.01); *C12N 15/86* (2013.01); *A61K 2039/543* (2013.01); *A61K 2039/545* (2013.01); *A61K 2039/55511* (2013.01); *A61K 2039/55588* (2013.01); *C12N 2770/24234* (2013.01)

(58) Field of Classification Search
CPC ............ A61K 2300/00; A61K 31/4745; A61K 31/7004; A61K 31/717; A61P 11/00
See application file for complete search history.

(56) References Cited

U.S. PATENT DOCUMENTS

| 6,121,020 A | 9/2000 | Selby et al. |
| 2016/0074507 A1 | 3/2016 | Manel et al. |

FOREIGN PATENT DOCUMENTS

| WO | WO 2001/026683 | 4/2001 |
| WO | WO 2003/002065 | 1/2003 |
| WO | WO03002065 | * 1/2003 |
| WO | WO 2005/087238 | 9/2005 |
| WO | WO 2007/054279 | 5/2007 |
| WO | WO 2007/112567 | 10/2007 |
| WO | WO 2007/121491 | 11/2007 |
| WO | WO 2014/189805 | 11/2014 |

(Continued)

OTHER PUBLICATIONS

Aghasadeghi, et al.; "Induction of Strong and Specific Humoral and T-helper 1 Cellular Responses by HBsAg Entrapped in the *Methanobrevibacter smithii* Archaeosomes"; Avicenna Journal of Medical Biotechnology; vol. 6, No. 4, pp. 238-245 (2014).

(Continued)

*Primary Examiner* — Barry A Chestnut
(74) *Attorney, Agent, or Firm* — Bozicevic Field & Francis, LLP; Paula A. Borden

(57) ABSTRACT

The present disclosure provides immunogenic compositions comprising: a) hepatitis C virus (HCV) E1E2 heterodimers, HCV E2, or HCV E1; and b) an adjuvant, where the adjuvant is a cyclic dinucleotide or an archaeosome. The present disclosure provides methods of inducing an immune response in an individual to HCV, the methods comprising administering to an individual an effective amount of an immunogenic composition of the present disclosure.

18 Claims, 52 Drawing Sheets
Specification includes a Sequence Listing.

(56) References Cited

FOREIGN PATENT DOCUMENTS

| WO | WO2014189805 | * 11/2014 |
| WO | WO 2015/132619 | 9/2015 |

OTHER PUBLICATIONS

Conlan, et al.; "Immunization of mice with lipopeptide antigens encapsulated in novel liposomes prepared from the polar lipids of various Archaeobacteria elicits rapid and prolonged specific protective immunity against infection with the facultative intracellular pathogen, Listeria monocytogenes"; Vaccine; vol. 19, No. 25-26, pp. 3509-3517 (May 14, 2001).

Dubensky, et al.; "Rationale, progress and development of vaccines utilizing STING-activating cyclic dinucleotide adjuvants"; Therapeutic Advances in Vaccines; vol. 1, No. 4, pp. 131-143 (2013).

Frey, et al.; "Safety and immunogenicity of HCV E1E2 vaccine adjuvanted with MF59 administered to healthy adults"; Vaccine; vol. 28, pp. 6367-6373 (2010).

Haq, et al.; "Archaeal lipid vaccine adjuvants for induction of cell-mediated immunity"; Expert Review of Vaccines; vol. 15, No. 12, pp. 1557-1566 (2016).

Krishnan, et al.; "Archaeosomes as Self-adjuvanting Delivery Systems for Cancer Vaccines"; Journal of Drug Targeting; vol. 11, No. 8-10, pp. 515-524 (2003).

Krishnan, et al.; "Archaeosomes Induce Long-Term CD8+ Cytotoxic T Cell Response to Entrapped Soluble Protein by the Exogenous Cytosolic Pathway, in the Absence of CD4+ T Cell Help"; J. Immunol.; vol. 165, No. 9, pp. 5177-5185 (2000).

Landi, et al.; "Superior immunogenicity of HCV envelope glycoproteins when adjuvanted with cyclic-di-AMP, a STING activator or archaeosomes"; Vaccine; vol. 35, pp. 6949-6956 (2017).

Ma, et al.; "DNA-based vaccination against hepatitis C virus (HCV): effect of expressing different forms of HCV E2 protein and use of CpG-optimized vectors in mice"; Vaccine; vol. 20, pp. 3263-3271 (2002).

Patel, et al.; "Mucosal and systemic immune responses by intranasal immunization using archaeal lipid-adjuvanted vaccines"; Vaccine; vol. 25, pp. 8622-8636 (2007).

Patel, et al.; "Safety of archaeosome adjuvants evaluated in a mouse model"; J. Liposome. Res.; vol. 12, No. 4, pp. 353-372 (Nov. 2002).

Patel, et al.; "Safety of intranasally administered archaeal lipid mucosal vaccine adjuvant and delivery (AMVAD) vaccine in mice"; International Journal of Toxicology; vol. 27, pp. 329-339 (2008).

Skrnjug; et al.; "The Mucosal Adjuvant Cyclic di-AMP Exerts Immune Stimulatory Effects on Dendritic Cells and Macrophages"; PLoS One; vol. 9, No. 4, 9 pages (Apr. 2014).

* cited by examiner

FIG. 5A
GenBank 3S7G_A
*Homo sapiens* IgG1 Fc
227 aa

```
  1 dkthtcppcp apellggpsv flfppkpkdt lmisrtpevt cvvvdvshed pevkfnwyvd
 61 gvevhnaktk preeqynsty rvvsvltvlh qdwlngkeyk ckvsnkalpa piektiskak
121 gqprepqvyt lppsrdeltk nqvsltclvk gfypsdiave wesngqpenn ykttppvlds
181 dgsfflyskl tvdksrwqqg nvfscsvmhe alhnhytqks lslspgk
```

GenBank AAN76044
*Homo sapiens* IgG2 Fc (amino acids 99-325)
227 aa

```
  1 stkgpsvfpl apcsrstses taalgclvkd yfpepvtvsw nsgaltsgvh tfpavlqssg
 61 lyslssvvtv pssnfgtqty tcnvdhkpsn tkvdktverk ccvecppcpa ppvagpsvfl
121 fppkpkdtlm isrtpevtcv vvdvshedpe vqfnwyvdgv evhnaktkpr eeqfnstfrv
181 vsvltvvhqd wlngkeykck vsnkglpapi ektisktkgq prepqvytlp psreemtknq
241 vsltclvkgf ypsdiavewe sngqpennyk ttppmldsdg sfflyskltv dksrwqqgnv
301 fscsvmheal hnhytqksls lspgk
```

GenBank AAW65947
*Homo sapiens* IgG3 Fc (amino acids 19-246)
238 aa

```
  1 hkpsntkvdk rvelktplgd tthtcppcpa pellggpsvf lfppkpkdtl misrtpevtc
 61 vvvdvshedp evkfnwyvdg vevhnaktkp reeqynstyr vvsvltvlhq dwlngkeykc
121 kvsnkalpap iektiskakg qprepqvytl ppsrdeltkn qvsltclvkg fypsdiavew
181 esngqpenny kttppvldsd gsfflysklt vdksrwqqgn vfscsvmhea lhnhytqksl
241 slspgk
```

FIG. 5B

GenBank AAA52770
*Homo sapiens* IgD Fc (amino acids 162-383)
222 aa

```
  1 ptkapdvfpi isgcrhpkdn spvvlaclit gyhptsvtvt wymgtqsqpq rtfpeiqrrd
 61 syymtssqls tplqqwrqge ykcvvqhtas kskkeifrwp espkaqassv ptaqpqaegs
121 lakattapat trntgrggee kkkekekeeq eeretktpec pshtqplgvy lltpavqdlw
181 lrdkatftcf vvgsdlkdah ltwevagkvp tggveeglle rhsngsqsqh srltlprslw
241 nagtsvtctl nhpslppqrl malrepaaqa pvklslnlla ssdppeaasw llcevsgfsp
301 pnillmwled qrevntsgfa parpppqprs ttfwawsvlr vpappspqpa tytcvvshed
361 srtllnasrs levsyvtdhg pmk
```

GenBank O308221A
*Homo sapiens* IgM Fc
276 aa

```
  1 vtstltikzs dwlgesmftc rvdhrgltfq qnassmcvpd qdtairvfai ppsfasiflt
 61 kstkltclvt dlttybsvti swtreengav kthtnisesh pnatfsavge asicedbdws
121 gerftctvth tdlpsplkqt isrpkgvalh rpbvyllppa rzzlnlresa titclvtgfs
181 padvfvewmq rgeplspqky vtsapmpepq apgryfahsi ltvseeewnt ggtytcvvah
241 ealpnrvter tvdkstgkpt lynvslvmsd tagtcy
```

FIG. 5C

GenBank P01876
*Homo sapiens* IgA Fc (amino acids 120-353)
234 aa

```
  1 asptspkvfp lslcstqpdg nvviaclvqg ffpqeplsvt wsesgqgvta rnfppsqdas
 61 gdlyttssql tlpatqclag ksvtchvkhy tnpsqdvtvp cpvpstpptp spstpptpsp
121 scchprlslh rpaledlllg seanltctlt glrdasgvtf twtpssgksa vqgpperdlc
181 gcysvssvlp gcaepwnhgk tftctaaype sktpltatls ksgntfrpev hllpppseel
241 alnelvtltc largfspkdv lvrwlqgsqe lprekyltwa srqepsqgtt tfavtsilrv
301 aaedwkkgdt fscmvgheal plaftqktid rlagkpthvn vsvvmaevdg tcy
```

GenBank 1F6A_B
*Homo sapiens* IgE Fc (amino acids 6-222)
212 aa

```
  1 adpcdsnprg vsaylsrpsp fdlfirkspt itclvvdlap skgtvnltws rasgkpvnhs
 61 trkeekqrng tltvtstlpv gtrdwieget yqcrvthphl pralmrsttk tsgpraapev
121 yafatpewpg srdkrtlacl iqnfmpedis vqwlhnevql pdarhsttqp rktkgsgffv
181 fsrlevtrae weqkdeficr avheaaspsq tvqravsvnp gk
```

GenBank P01861
*Homo sapiens* IgG4 Fc (amino acids 100-327)
228 aa

```
  1 astkgpsvfp lapcsrstse staalgclvk dyfpepvtvs wnsgaltsgv htfpavlqss
 61 glyslssvvt vpssslgtkt ytcnvdhkps ntkvdkrves kygppcpscp apeflggpsv
121 flfppkpkdt lmisrtpevt cvvvdvsqed pevqfnwyvd gvevhnaktk preeqfnsty
181 rvvsvltvlh qdwlngkeyk ckvsnkglps siektiskak gqprepqvyt lppsqeemtk
241 nqvsltclvk gfypsdiave wesngqpenn ykttppvlds dgsfflysrl tvdksrwqeg
301 nvfscsvmhe alhnhytqks lslslgk
```

FIG. 6

Table 1. Conserved Regions based on the conserved CD4 epitopes

| No. | Residues* | Length | Sequence | Genotype Conservancy | # of included Epitopes |
|---|---|---|---|---|---|
| CD4-R1 | 1251-1265 | 15 | VLVLNPSVAATLGFG | HCV1a, 1b, 2a, 2b, 3, 4, 5, 6, 7 | 2 |
| CD4-R2 | 1295-1309 | 15 | TYGKFLADGGCSGGA | HCV1a, 1b, 3, 4, 5, 6, 7 | 2 |
| CD4-R3 | 1387-1401 | 15 | GGRHLIFCHSKKKCD | HCV1a, 1b, 2a, 2b, 3, 4, 5, 6, 7 | 4 |
| CD4-R4 | 1415-1425 | 11 | VAYYRGLDVSV | HCV1a, 1b, 2b, 3, 4, 7 | 4 |
| CD4-R5 | 1436-1453 | 18 | ATDALMTGFTGDFDSVID | HCV1a, 1b, 3, 4, 7 | 2 |
| CD4-R6 | 1563-1577 | 15 | TGLTHIDAHFLSQTK | HCV1a, 1b, 2a, 2b, 3, 7 | 1 |
| CD4-R7 | 1773-1785 | 13 | QYLAGLSTLPGNP | HCV1a, 1b, 2a, 2b, 3, 4, 5, 6, 7 | 4 |
| CD4-R8 | 1881-1888 | 8 | NLLPAILS | HCV1a, 1b, 2b, 3, 4, 7 | 1 |
| CD4-R9 | 1904-1930 | 27 | RHVGPGEGAVQWMNRLIAFASRGNHVS | HCV1a, 1b, 3, 4 | 3 |
| CD4-R10 | 2201-2215 | 15 | SSASQLSAPSLKATC | HCV1a, 1b, 2b, 3, 4, 5, 6 | 1 |
| CD4-R11 | 2788-2792 | 5 | SNVSV | HCV1a, 1b, 2a, 2b, 3, 4, 5, 6, 7 | 1 |

* Numbers are based on HCV1a genotype sequence. R = region

FIG. 7

Table 2. Number of located HCV CD8 T cell epitopes and anchor positions for common each HLA-I Alleles in USA

| MHC-I Allele | Total Epitopes (#) | Located Epitopes (#) | Allele-specific Anchor Positions | | |
|---|---|---|---|---|---|
| | | | 2 | 9 | Others |
| A*02:01 | 48 | 29 | M#, L, Q, V, I | V, L, I, A, M | F (1, 3, 7) |
| A*24:02 | 33 | 20 | Y, W, F | F, I, W, L, M | F, W (7) |
| A*03:01 | 10 | 6 | M, L, I, V, T, S, Q, A | K, Y, R | F & Y (3), K & R (1) |
| A*01:01 | 4 | 3 | T, S, A, V, M, I, L | Y, F | D (3) |
| B*35:01 | 1 | 1 | P, G, A | Y, M, F, H | M (1), A (8), W (1), F (1), Y (1), P (8) |
| | | | 5 | 9 | Others |
| B*08:01 | 2 | 1 | R, K, H, F | L, M, I, F, V, A, W | K (3), R (3), L (2), F (6), M (1, 2, 3), P (2), S (8) |
| | | | 1 | 2 | Others |
| B*40:02 | 2 | 2 | Y, K, R, A, H, W, G, F, Q, L, S, C, I, T, M, V | E, D | I, L, A, V, F, M, T, W, S, C | F (3), P (8), A (8) |
| C*03:03 | 2 | 2 | NA## | NA | NA |
| A*33:03 | 1 | 0 | - | - | - |
| A*02:06 | 1 | 0 | - | - | - |
| A*26:01 | 1 | 0 | - | - | - |
| A*31:01 | 1 | 0 | - | - | - |
| Total | 106 | 64 | | | |

Bold Anchor positions describe the optimal amino acid for that location. ## Not Available

FIG. 8

Table 3. Conserved Regions based on the conserved CD8 Epitopes

| No. | Residues* | Length | Sequence | Conserved HCV1a, 1b, & 3 | Conserved 9** Genotypes | # of epitopes |
|---|---|---|---|---|---|---|
| CD8-R1 | 1292-1300 | 9 | TYSTYGKFL | Yes | Yes | 2 |
| CD8-R2 | 1391-1399 | 9 | LIFCHSKKK | Yes | Yes | 2 |
| CD8-R3 | 1436-1451 | 16 | ATDALMTGFTGDFDSV | Yes | No | 2 |
| CD8-R4 | 1666-1675 | 10 | VLAALAAYCL | Yes | No | 1 |
| CD8-R5 | 1851-1859 | 9 | ILAGYGAGV | Yes | No | 1 |
| CD8-R6 | 1373-1380 | 8 | IPFYGKAI | Yes | No | 1 |
| CD8-R7 | 1596-1604 | 9 | RAQAPPPSW | Yes | No | 1 |
| CD8-R8 | 1910-1945 | 36 | EGAVQWMNRLIAFASRGN HVSPTHYVPESDAAARVT | Yes | No | 3 |
| CD8-R9 | 2290-2298 | 9 | RPDYNPPLL | Yes | No | 1 |
| CD8-R10 | 2557-2565 | 9 | TIMAKNEVF | Yes | Yes | 1 |

* Numbers are based on HCV1a genotype sequence.

** Nine genotypes include HCV1a, 1b, 2a, 2b, 3, 4, 5, 6, and 7

FIG. 9A. CD4 and CD8 epitopes for Core, P7, and NS2 regions

| Name | Type of epitope | Start* | End* |
|---|---|---|---|
| Core-1 | CD4 | 1 | 20 |
| Core-2 | CD4 | 11 | 30 |
| Core-3 | CD4 | 21 | 40 |
| Core-4 | CD4 | 39 | 63 |
| Core-5 | CD4 | 47 | 70 |
| Core-6 | CD4 | 61 | 80 |
| Core-7 | CD4 | 71 | 90 |
| Core-8 | CD4 | 81 | 100 |
| Core-9 | CD4 | 91 | 110 |
| Core-10 | CD4 | 101 | 115 |
| Core-11 | CD4 | 111 | 130 |
| Core-12 | CD4 | 125 | 139 |
| Core-13 | CD4 | 131 | 150 |
| Core-14 | CD4 | 151 | 170 |
| Core-15 | CD4 | 161 | 180 |
| Core-16 | CD8 | 35 | 44 |
| Core-17 | CD8 | 43 | 51 |
| Core-18 | CD8 | 51 | 59 |
| Core-19 | CD8 | 129 | 137 |
| Core-20 | CD8 | 131 | 140 |
| Core-21 | CD8 | 150 | 158 |
| Core-22 | CD8 | 154 | 162 |
| Core-23 | CD8 | 168 | 176 |
| Core-24 | CD8 | 177 | 187 |
| Core-25 | CD8 | 178 | 187 |
| P7-1 | CD8 | 803 | 811 |
| NS2-1 | CD4 | 955 | 974 |
| NS2-2 | CD4 | 975 | 994 |
| NS2-3 | CD4 | 985 | 1,004 |
| NS2-4 | CD4 | 1,015 | 1,034 |
| NS2-5 | CD4 | 1,035 | 1,054 |
| NS2-6 | CD8 | 924 | 933 |
| NS2-7 | CD8 | 961 | 970 |
| NS2-8 | CD8 | 989 | 997 |

* Start and End numbers are based on sequence designated "Consensus" in Fig. 12A-12L.

FIG. 9B. CD4 and CD8 epitopes that are conserved among genotypes 1a, 1b, 2a, 2b, and 3

| Name | Type of epitope | Start* | End* |
|---|---|---|---|
| NS3-1 | CD4 | 1,265 | 1,279 |
| NS3-2 | CD4 | 1,309 | 1,323 |
| NS3-3 | CD4 | 1,401 | 1,415 |
| NS3-4 | CD4 | 1,402 | 1,412 |
| NS3-5 | CD4 | 1,429 | 1,439 |
| NS3-6 | CD4 | 1,450 | 1,464 |
| NS3-7 | CD4 | 1,453 | 1,467 |
| NS3-8 | CD4 | 1,577 | 1,591 |
| NS3-9 | CD8 | 1,306 | 1,314 |
| NS3-10 | CD8 | 1,387 | 1,394 |
| NS3-11 | CD8 | 1,405 | 1,413 |
| NS3-12 | CD8 | 1,450 | 1,458 |
| NS3-13 | CD8 | 1,457 | 1,465 |
| NS3-14 | CD8 | 1,610 | 1,618 |
| NS4a-1 | CD8 | 1,683 | 1,692 |
| NS4b-1 | CD4 | 1,790 | 1,801 |
| NS4b-2 | CD4 | 1,792 | 1,802 |
| NS4b-3 | CD4 | 1,898 | 1,905 |
| NS4b-4 | CD4 | 1,921 | 1,935 |
| NS4b-5 | CD4 | 1,922 | 1,941 |
| NS4b-6 | CD4 | 1,928 | 1,947 |
| NS4b-7 | CD8 | 1,868 | 1,876 |
| NS4b-8 | CD8 | 1,927 | 1,942 |
| NS4b-9 | CD8 | 1,932 | 1,940 |
| NS4b-10 | CD8 | 1,948 | 1,962 |
| NS5a-1 | CD4 | 2,218 | 2,232 |
| NS5a-2 | CD8 | 2,309 | 2,317 |
| NS5b-1 | CD4 | 2,847 | 2,851 |
| NS5b-2 | CD8 | 2,602 | 2,610 |

* Start and End numbers are based on sequence designated "Consensus" in Fig. 12A-12L.

FIG. 10A

| Name | Sequence* | Start** | End** | Contained Epitopes |
|---|---|---|---|---|
| TP29 | AIPLEVIKGGRHLIFCHSKKKCDELAAKL | 1,393 | 1,421 | NS3-3, NS3-4, NS3-11 |
| TP50 | LGALTGTYVYNHLTPLRDWAHNGLRDLAVAVEPVVFSQMETKLITWGADT | 955 | 1,004 | NS2-1, NS2-2, NS2-3, NS2-7, NS2-8 |
| TP52 | AIPLEVIKGGRHLIFCHSKKKCDELAAKLVALGINAVAYYRGLDVSVIPTSG | 1,393 | 1,444 | NS3-3, NS3-4, NS3-5, NS3-11 |
| TP70 | KGGRHLIFCHSKKKCDELAAKLVALGINAVAYYRGLDVSVIPTSGDVVVVATDALMTGFTGDFDSVIDCN | 1,400 | 1,469 | NS3-3, NS3-4, NS3-5, NS3-6, NS3-7, NS3-11, NS3-12, NS3-13 |
| TP100 | VALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDF | 1,379 | 1,478 | NS3-3, NS3-4, NS3-5, NS3-6, NS3-7, NS3-10, NS3-11, NS3-12, NS3-13 |
| TP171 | MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPG | 1 | 171 | Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 |
| TP228 | LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN | 1,242 | 1,469 | NS3-1, NS3-2, NS3-3, NS3-4, NS3-5, NS3-6, NS3-7, NS3-9, NS3-10, NS3-11, NS3-12, NS3-13 |
| TP553 | QASLLKVPYFVRVQGLLRICALARKMAGGHYVQMAIIKLGALTGTYVYNALTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGK | 917 | 1,469 | NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, NS3-13 |

FIG. 10B

| | AIPLEVIKGGRHLIFCHSKKKCDELAAKLV ALGINAVAYYRGLDVSVIPTSGDVVVVAT DALMTGFTGDFDSVIDCN | | | |
|---|---|---|---|---|
| TP778 | LHAPTGSGKSTKVPAAYAAQGYKVLVLNP SVAATLGFGAYMSKAHGIDPNIRTGVRTIT TGSPITYSTYGKFLADGGCSGGAYDIIICDE CHSTDATSILGIGTVLDQAETAGARLVVLA TATPPGSVTVPHPNIEEVALSTTGEIPFYGK AIPLEVIKGGRHLIFCHSKKKCDELAAKLV ALGINAVAYYRGLDVSVIPTSGDVVVVAT DALMTGFTGDFDSVIDCNTCVTQTVDFSL DPTFTIETTTLPQDAVSRTQRRGRTGRGKP GIYRFVAPGERPSGMFDSSVLCECYDAGCA WYELTPAETTVRLRAYMNTPGLPVCQDHL EFWEGVFTGLTHIDAHFLSQTKQSGENLPY LVAYQATVCARAQAPPPSWDQMWKCLIR LKPTLHGPTPLLYRLGAVQNEVTLTHPITK YIMTCMSADLEVVTSTWVLVGGVLAALA AYCLSTGCVVIVGRIVLSGKPAIIPDREVLY REFDEMEECSQHLPYIEQGMMLAEQFKQK ALGLLQTASRQAEVIAPAVQTNWQKLEAF WAKHMWNFISGIQYLAGLSTLPGNPAIASL MAFTAAVTSPLTTSQTLLFNILGGWVAAQ LAAPGAATAFVGAGLAGAAIGSVGLGKVL VDILAGYGAGVAGALVAFKIMSGEVPSTE DLVNLLPAILSPGALVVGVVCAAILRRHVG PGEGAVQWMNRLIAFASRGNHVSPTHYVP ESDAAARVTAILSSLTVTQLLRRLHQWISS ECTTPCSGSWLRDIWDWICEVLSDFKTWL KAKLMPQLPG | 1,242 | 2,022 | NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10 |

FIG. 10C

| TP1985 | APITAYAQQTRGLLGCIITSLTGRDKNQVE GEVQIVSTAAQTFLATCINGVCWTVYHGA GTRTIASPKGPVIQMYTNVDQDLVGWPAP QGARSLTPCTCGSSDLYLVTRHADVIPVRR RGDSRGSLLSPRPISYLKGSAGGPLLCPAG HAVGIFRAAVCTRGVAKAVDFIPVENLETT MRSPVFTDNSSPPAVPQSFQVAHLHAPTGS GKSTKVPAAYAAQGYKVLVLNPSVAATL GFGAYMSKAHGIDPNIRTGVRTITTGSPITY STYGKFLADGGCSGGAYDIIICDECHSTDA TSILGIGTVLDQAETAGARLVVLATATPPG SVTVPHPNIEEVALSTTGEIPFYGKAIPLEVI KGGRHLIFCHSKKKCDELAAKLVALGINA VAYYRGLDVSVIPTSGDVVVVATDALMTG FTGDFDSVIDCNTCVTQTVDFSLDPTFTIET TTLPQDAVSRTQRRGRTGRGKPGIYRFVAP GERPSGMFDSSVLCECYDAGCAWYELTPA ETTVRLRAYMNTPGLPVCQDHLEFWEGVF TGLTHIDAHFLSQTKQSGENLPYLVAYQAT VCARAQAPPPSWDQMWKCLIRLKPTLHGP TPLLYRLGAVQNEVTLTHPITKYIMTCMSA DLEVVTSTWVLVGGVLAALAAYCLSTGC VVIVGRIVLSGKPAIIPDREVLYREFDEMEE CSQHLPYIEQGMMLAEQFKQKALGLLQTA SRQAEVIAPAVQTNWQKLEAFWAKHMWN FISGIQYLAGLSTLPGNPAIASLMAFTAAVT SPLTTSQTLLFNILGGWVAAQLAAPGAATA FVGAGLAGAAIGSVGLGKVLVDILAGYGA GVAGALVAFKIMSGEVPSTEDLVNLLPAIL SPGALVVGVVCAAILRRHVGPGEGAVQW MNRLIAFASRGNHVSPTHYVPESDAAARV TAILSSLTVTQLLRRLHQWISSECTTPCSGS WLRDIWDWICEVLSDFKTWLKAKLMPQLP GIPFVSCQRGYRGVWRGDGIMHTRCHCGA EITGHVKNGTMRIVGPRTCRNMWSGTFPIN AYTTGPCTPLPAPNYTFALWRVSAEEYVEI RQVGDFHYVTGMTTDNLKCPCQVPSPEFF TELDGVRLHRFAPPCKPLLREEVSFRVGLH EYPVGSQLPCEPEPDVAVLTSMLTDPSHIT AEAAGRRLARGSPPSVASSSASQLSAPSLK ATCTANHDSPDAELIEANLLWRQEMGGNI TRVESENKVVILDSFDPLVAEEDEREISVPA EILRKSRRFAPALPIWARPDYNPPLLETWK KPDYEPPVVHGCPLPPQSPPVPPPRKKRT VVLTESTVSTALAELATKSFGSSSTSGITGD NTTTSSEPAPSGCPPDSDAESYSSMPPLEGE | 1041 | 3073 | NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 |

FIG. 10D

| | PGDPDLSDGSWSTVSSEADTEDVVCCSMS YSWTGALVTPCAAEEQKLPINALSNSLLRH HNLVYSTTSRSACQRQKKVTFDRLQVLDS HYQDVLKEVKAAASKVKANLLSVEEACSL TPPHSAKSKFGYGAKDVRCHARKAVNHIN SVWKDLLEDSVTPIDTTIMAKNEVFCVQPE KGGRKPARLIVFPDLGVRVCEKMALYDVV SKLPLAVMGSSYGFQYSPGQRVEFLVQAW KSKKTPMGFSYDTRCFDSTVTESDIRTEEAI YQCCDLDPQARVAIKSLTERLYVGGPLTNS RGENCGYRRCRASGVLTTSCGNTLTCYIK ARAACRAAGLQDCTMLVCG<u>NN</u>LVVICESA GVQEDAASLRAFTEAMTRYSAPPGDPPQP EYDLELITSCSSNVSVAHDGAGKRVYYLTR DPTTPLARAAWETARHTPVNSWLGNIIMF APTLWARMILMTHFFSVLIARDQLEQALD CEIYGACYSIEPLDLPPIIQRLHGLSAFSLHS YSPGEINRVAACLRKLGVPPLRAWRHRAR SVRARLLSRGGRAAICGKYLFNWAVRTKL KLTPIAAAGQLDLSGWFTAGYSGGDIYHS VSHARPRWFWFCLLLLAAGVGIYLLPNR | | | |

\* TP sequences are based on HCV1a consensus sequence and gaps were removed
\*\* Start and End numbers are based on sequence designated "Consensus" in Fig. 16A-16L.

HCV1a consensus  YHKFNSSGCPERLASCRPLTDFDQGWGPISYANG-SGP-DQRPYCWHYPPKPCGIVPAKSVCGPVYCFTP---SP HCV1a consensus  VVVGTTDRSGAPTYNWGENDTDVFVLN HCV1a consensus  DWICEVLSDFKTWLKAKLMPQLPGIPFVSCQRGYRGVWRGDGIMHTRCHCGAEITGHVKNGTMRIVGPRTCRNM HCV1a consensus  WSGTFPINAYTTGPCTPLPAPNYTFALWRVSAEFYVEIRQVGDFHYVTGMTTDNLKCPCQVPSPEFFTELDGVR HCV1a consensus  LHRFAPPCKPLLREEVSFRVGLHEYPVGSQLPCEPEPDVAVLTSMLTDPSHITAEAAGRRLARGSPPSVASSSA

FIG. 11J

HCV1a consensus VNSWLGNIIMFAPTLWARMILMTHFFSVLIARDQLEQALDCEIYGACYSIEPLDLPPIIQRLHGLSAFSLHSYS HCV1a consensus PGEINRVAACLRKLGVPPLRAWRHRARSVRARLLSR

```
                  2,840     2,850     2,860     2,870     2,880     2,890     2,900     2,910     2,920
Consensus         LELITSCSSNVSVAHDXSGKRVYYLTRDPTTPLARAAWETARHTP---VNSWLGNIIMYAPTIWVRMVLMTHFFSILQXQEQLEXA
                  NS5b 1. HCV1a consensus   LELITSCSSNVSVAHDGAGKRVYYLTRDPTTPLARAAWETARHTP---VNSWLGNIIMFAPTLWARMILMTHFFSVLIARDQLEQA
2. HCV1b consensus   LELITSCSSNVSVAHDASGKRVYYLTRDPTTPLARAAWETARHTP---VNSWLGNIIMYAPTLWARMILMTHFFSILLAQEQLEKA
3. HCV2a Consensus   LELITSCSSNVSVALGPQGRRRYYLTRDPTTPIARAAWETVRHSP---VNSWLGNIIQYAPTIWVRMVLMTHFFSILMAQDTLDQN
4. HCV2b Consensus   LELITSCSSNVSVALDSRGRRRYFLTRDPTTPITRAAWETVRHSP---VNSWLGNIIQYAPTIWVRMVIMTHFFSILLAQDTLNQN
5. HCV 3 Consensus   LELITSCSSNVSVARDNKGKRYYYLTRDATTPLARAAWETARHTPGWGVNSWLGNIIMYAPTIWVRMVMMTHFFSILQSQEILDRP
6. HCV 4 Consensus   LELITSCSSNVSVAHDATGKKVYYLTRDPETPLARAAWETVRHTP---VNSWLGNIIVYAPTIWVRMVLMTHFFSILQSQEALEKA
7. HCV5 consensus    LELVTSCSSNVSVARDASGNRVYYLTRDPQVPLARAAWETAKHSP---VNSWLGNIIMYAPTLWARIVLMTHFFSVLQSQEQLEKA
8. HCV6 consensus    LELITSCSSNVSVAHDGTGQRYYYLTRDPTTPLARAAWETARHTP---VNSWLGNIIMYAPTIWVRMVLMTHFFQILQSQEQLHKA
9. HCV7: ABN05226   LEHIDSCSSNVSVARDNSGKRVYYLTRDPTNPLSRAAWETARHSP---VNSWVGNIIMFAPTIWVRMVLMTHFFALLNEERLNDP
14. AVI1a-129       LELITSCSSNVSVAHDGAGKRVYYLTRDPTTPLARAAWETARHTP---VNSWLGNIIMFAPTLWARMVLMTHFFSVLIARDQLEQA
15. AVI3a-177       LELITSCSSNVSVARDNKGKRYYYLTRDATTPLARAAWETARHTP---VNSWLGNIIMYAPTIWVRMVMMTHFFSILQSQEILDRP 2,930     2,940     2,950     2,960     2,970     2,980     2,990     3,000     3,010
Consensus         LDFEMYGATYSVTPLDLPAIIQRLHGLSAFSLHSYSPGELNRVAACLRKLGVPPLRAWRHRARAVRAKLIAQGGRAAICGKYLFNW
                  NS5b 1. HCV1a consensus   LDCEIYGACYSIEPLDLPPIIQRLHGLSAFSLHSYSPGEINRVAACLRKLGVPPLRAWRHRARSVRARLLSRGGRAAICGKYLFNW
2. HCV1b consensus   LDCQIYGACYSIEPLDLPQIIQRLHGLSAFSLHSYSPGEINRVASCLRKLGVPPLRVWRHRARSVRAKLLSQGGRAATCGKYLFNW
3. HCV2a Consensus   LNFEMYGSVYSVSPLDLPAIIERLHGLDAFSLHTYTPHELTRVASALRKLGAPPLRAWKSRARAVRASLISRGGRAAVCGRYLFNW
4. HCV2b Consensus   LNFEMYGAVYSVNPLDLPAIIERLHGLDAFSLHTYSPHELSRVAATLRKLGAPPLRAWKSRARAVRASLIAQGGRAAICGRYLFNW
5. HCV 3 Consensus   LDFEMYGATYSVTPLDLPAIIERLHGLSAFTLHSYSPVELNRVAGTLRKLGCPPLRAWRHRARAVRAKLIAQGGKAKICGLYLFNW
6. HCV 4 Consensus   LDFDMYGVTYSITPLDLPAIIQRLHGLSAFTLHGYSPHELNRVAGSLRKLGVPPLRAWRHRARAVRAKLIAQGGKAKICGIYLFNW
7. HCV5 consensus    LAFEMYGSVYSVTPLDLPAIIQRLHGLSAFSLHSYSPSEINRVASCLRKLGVPPLRAWRHRARAVRAKLIAQGGKAAICGIYLFNW
8. HCV6 consensus    LDFDIYGVTYSITPLDLPAIIQRLHGMAAFSLHGYSPGELNRVAACLRKLGAPPLRAWRHRARAVRAKLIAQGGKAAICGKYLFNW
9. HCV7: ABN05226   VSFEMYGATYTVCPTDLPDIIQRLHGLRAFELHTYSPAELTRVAATLRKLGVPPLRTWRQRARKVRAGLIGQGGRARICGLYLFNW
14. AVI1a-129       LDCEIYGACYSIEPLDLPPIIQRLHGLSAFSLHSYSPGEINRVAACLRKLGVPPLRTWRHRARSVRAKLLSRGGRAAICGKYLFNW
15. AVI3a-177       LDFEMYGATYSVTPLDLPAIIERLHGLSAFTLHSYSPVELNRVAGTLRKLGCPPLRAWRHRARAVRAKLIAQGGKAKICGLYLFNW 3,020     3,030     3,040     3,050     3,060          3,074
Consensus         AVRTKLKLTPLPAAGXLDLSSWFTVGAGGGDIYHSVSRARPRWLLLCLLLLXVGVGIFLLPARX
                  NS5b 1. HCV1a consensus   AVRTKLKLTPIAAAGQLDLSGWFTAGYSGGDIYHSVSHARPRWFWFCLLLLAAGVGIYLLPNRX
2. HCV1b consensus   AVRTKLKLTPIPAASQLDLSGWFVAGYSGGDIYHSLSRARPRWFMWCLLLLSVGVGIYLLPNRX
3. HCV2a Consensus   AVKTKLKLTPLPEARLLDLSSWFTVGAGGGDIYHSVSRARPRLLLLSLLLLXVGVGLFLLPAR
4. HCV2b Consensus   AVKTKLKLTPLPEASRLDLSGWFTVGAGGGDIFHSVSHARPRLLLLCLLLLSVGVGIFLLPAR
5. HCV 3 Consensus   AVRTKTKLTPLPAAGQLDLSSWFTVGVGGNDIYHSVSRARTRXLLLCLLLLTVGVGIFLLPAR
6. HCV 4 Consensus   AVKTKLKLTPLPAAANLDLSSWFTVGAGGGDIYHSVSRARPRYLLLCLLLLSVGVGIFLLPAR
7. HCV5 consensus    AVKTKRKLTPLADADRLDLSSWFTVGAGGGDIYHSMSRARPRXJLLCLLLLXVGVGIFLLPAR
8. HCV6 consensus    AVKTKLKLTPLRGASKLDLSGWFVAGYSGGDIYHSVSRARPRMLLLCLLLLTVGVGIFLLPAR
9. HCV7: ABN05226   AVRTKIKLTPLAGAGRLDLSSWFSVCAGEADVDHSTPRAHPRPLLLCLLLLAVGVGIFLLPAR
14. AVI1a-129       AVRTKLKLTPIAAAGRLDLSGWFTAGYSGGDIYHSVSHARPRWFWFCLLLLAAGVGIYLLPNR
15. AVI3a-177       AVRTKTNLTPLPAAGQLDLSSWFTVGVGGNDIYHSVSRARTRHLLLCLLLLTVGVGIFLLPAR
```

HEPATITIS C VIRUS IMMUNOGENIC COMPOSITIONS AND METHODS OF USE THEREOF

CROSS-REFERENCE

This application is a national stage filing under 35 U.S.C. § 371 of PCT/CA2017/051192, filed Oct. 5, 2017, which claims the benefit of U.S. Provisional Patent Application No. 62/406,770, filed Oct. 11, 2016, which applications are incorporated herein by reference in their entirety.

INTRODUCTION

Hepatitis C virus (HCV) is a blood-borne pathogen that is estimated to infect 150-200 million people worldwide. Infection by HCV may be non-symptomatic, and can be cleared by patients, sometimes without medical intervention. However, the majority of patients develop a chronic HCV infection, which may lead to liver inflammation, scarring, and even to liver failure or liver cancer. In the United States alone, over 3 million people have a chronic infection.

The HCV virion contains a positive-sense single stranded RNA genome of about 9.5 kb. The genome encodes a single polyprotein of 3,010 to 3,030 amino acids. The structural proteins comprise a core protein forming the viral nucleocapsid and two envelope glycoproteins, E1 and E2.

A vaccine based on the recombinant envelope glycoproteins (rE1E2) from a single genotype 1a strain (HCV-1) protected chimpanzees from chronic infection following homologous and heterologous genotype 1a (gt1a) viral challenge (reviewed in Houghton, M *Immunol Rev* 2011). Antisera from the immunized chimpanzees were shown to exhibit in vitro cross-neutralizing activity (Meunier et al. (2011) *J. Infect. Dis.* 204:1186). A phase I clinical trial was conducted in human volunteers with a similar antigen (Frey et al. (2010) *Vaccine* 28:6367). Antisera from selected vaccinated individuals were similarly capable of neutralizing chimeric cell culture-derived viruses (HCVcc) expressing the structural proteins of strains representing all 7 major HCV genotypes in vitro (Law et al. (2013) *PLoS One* 8:e59776) and to be able to compete with the binding of numerous discrete monoclonal antibodies with broad cross-neutralizing activities (Wong et al. (2014) *J. Virol.* 88:14278).

There is a need in the art for compositions and methods for inducing immune responses to HCV.

SUMMARY

The present disclosure provides immunogenic compositions comprising: a) hepatitis C virus (HCV) E1E2 heterodimers, HCV E2, or HCV E1; and b) an adjuvant, where the adjuvant is a cyclic dinucleotide or an archaeosome. The present disclosure provides methods of inducing an immune response in an individual to HCV, the methods comprising administering to an individual an effective amount of an immunogenic composition of the present disclosure.

BRIEF DESCRIPTION OF THE DRAWINGS

FIG. 1A-1C provide an amino acid sequence alignment of examples of the core-E1-E2 coding regions of a HCV genotype 1 virus, specifically representative HCV 1A, 1B and 1C genotypes. Genbank database sequences for the coding region core-E1-E2 were aligned using Geneious software v5.6.4. Numbering of amino acids is according to strain NP_671941 (H77). Consensus: SEQ ID NO:1; AVI1a129: SEQ ID NO:2; NP_671491 (H77): SEQ ID NO:3; EU155269: SEQ ID NO:4; EU781810: SEQ ID NO:5; EU781771: SEQ ID NO:6; AB250610: SEQ ID NO:7; EU781752: SEQ ID NO:8; EU781759: SEQ ID NO:9; EF407439: SEQ ID NO:10; EF407427: SEQ ID NO:11; EU362905: SEQ ID NO:12; EF407413: SEQ ID NO:13; EU781808: SEQ ID NO:14; EU78170: SEQ ID NO:15; AJ238799 (Con1): SEQ ID NO:16; AAK97744: SEQ ID NO:17; AF139594: SEQ ID NO:18; AF176573: SEQ ID NO:19; BAA19625: SEQ ID NO:20; BAA25076: SEQ ID NO:21; BAC54896: SEQ ID NO:22; BAD91386: SEQ ID NO:23; BAF46764: SEQ ID NO:24; BAG30950: SEQ ID NO:25; CAB41951: SEQ ID NO:26; AAK95832: SEQ ID NO:27; AAT69968: SEQ ID NO:28; and BAA03581: SEQ ID NO:29.

FIG. 2A-2C provide an alignment of amino acid sequences of the core-E1-E2 coding region of representative HCV 2A and HCV2B subtypes. Genbank database sequences for the coding region core-E1-E2 were aligned using Geneious software v5.6.4. The amino acid numbering depicted is in accordance to the common HCV strains: AB047639 (JFH1) and HPCJ8G-J8 (J8) for HCV2A and HCV2B, respectively. AB047639 (JFH1): SEQ ID NO:30; AB047645: SEQ ID NO:31; AF169003: SEQ ID NO:32; AF169005: SEQ ID NO:33; AF238482: SEQ ID NO:34; AY746460: SEQ ID NO:35; HPCPOLP: SEQ ID NO:36; NC_009823: SEQ ID NO:37; HPCJ8G HC-J8: SEQ ID NO:38; AB030907: SEQ ID NO:39; AY232730: SEQ ID NO:40; AY232747: SEQ ID NO:41; and DQ430817: SEQ ID NO:42.

FIG. 3A-3C provide an amino acid sequence alignment of the core-E1-E2 coding region for representative HCV 3A, 3B and 3K genotypes. Genbank database sequences for the coding region core-E1-E2 were aligned using Geneious software v5.6.4. Consensus: SEQ ID NO:43; AVI3a177: SEQ ID NO:44; YP_0014696: SEQ ID NO:45; CAA54244: SEQ ID NO:46; AAC03058: SEQ ID NO:47; AAY29642: SEQ ID NO:48; ABD85062: SEQ ID NO:49; ABD85063: SEQ ID NO:50; ABD97104: SEQ ID NO:51; BAA06044: SEQ ID NO:52; BAA08372: SEQ ID NO:53; and BAA09890: SEQ ID NO:54.

FIG. 5A-5C provide amino acid sequences of immunoglobulin Fc regions for GenBank 3S7G_A *Homo sapiens* IgG1 Fc: SEQ ID NO:56; GenBank AAN76044 *Homo sapiens* IgG2 Fc: SEQ ID NO: 57; GenBank AAW65947 *Homo sapiens* IgG3 Fc: SEQ ID NO:58; GenBank AAA52770 *Homo sapiens* IgD Fc: SEQ ID NO:59; GenBank 0308221A *Homo sapiens* IgM Fc: SEQ ID NO:60; GenBank P01876 *Homo sapiens* IgA Fc: SEQ ID NO:61; GenBank IF6A_B *Homo sapiens* IgE Fc: SEQ ID NO:62; and GenBank P01861 *Homo sapiens* IgG4 Fc: SEQ ID NO:63.

FIG. 6 presents Table 1, which provides conserved regions based on conserved CD4 epitopes (CD4$^+$ T cell epitopes) conserved among HCV genotypes. Top to Bottom: SEQ ID NOs.:64-74.

FIG. 7 presents Table 2, which provides the number of located HCV CD8+ T cell epitopes and anchor positions for common human leukocyte antigen (HLA)-I Alleles in the United States.

FIG. 8 presents Table 3, which provides conserved regions based on CD8 epitopes (CD8+ T cell epitopes) conserved among HCV genotypes. Top to Bottom: SEQ ID NOs.:75-84.

FIG. 9A-9B provide a list of CD4 and CD8 epitopes that are conserved among HCV genotypes 1a, 1b, 2a, 2b, and 3.

FIG. 10A-10D provide amino acid sequences of examples of polypeptides comprising multiple T-cell epitopes (TP29: SEQ ID NO:85; TP50: SEQ ID NO:86; TP52: SEQ ID NO:87; TP70: SEQ ID NO:88; TP100: SEQ ID NO:89; TP171: SEQ ID NO:90; TP228: SEQ ID NO:91; TP553: SEQ ID NO:92; TP778: SEQ ID NO:93; and TP1985: SEQ ID NO:94). The start and end amino acids are based on the sequence designated "Consensus" in FIG. 12A-12L. The T-cell epitopes contained within each polypeptide are provided; the T-cell epitope designations correspond to those presented in FIG. 11A-11N.

FIG. 12A-12L provide consensus amino acid sequences of HCV polypeptides (SEQ ID NOs.96-107).

DEFINITIONS

Figure 4A:
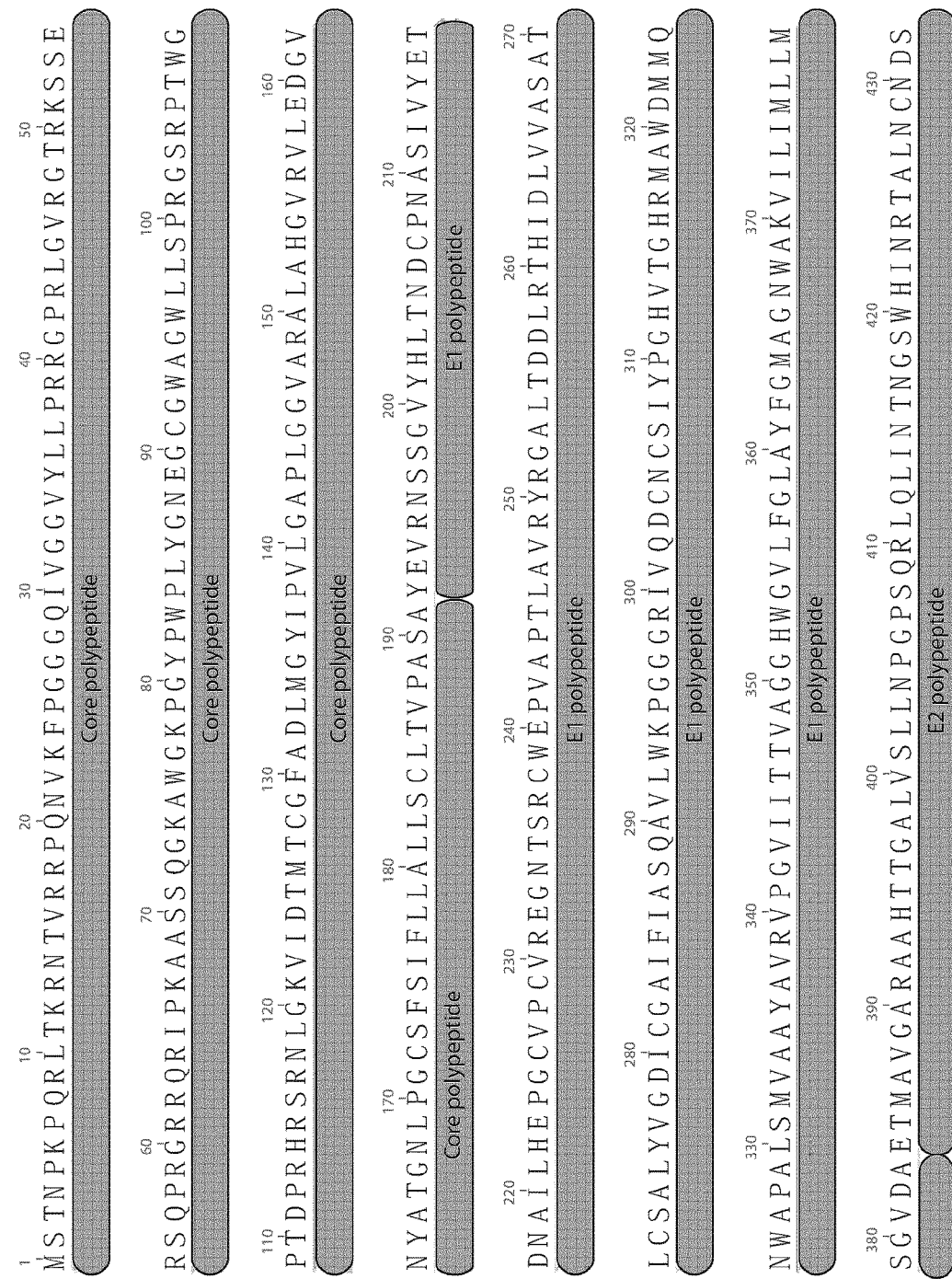
FIG. 4A-4B provide an amino acid sequence of the core-E1-E2 coding region for HCV genotype 7a. Amino acid sequence for the coding region core-E1-E2 of genotype 7a (isolate QC69; Genbank: ABN05226.1; SEQ ID NO:55) is shown according to the numbering scheme of the reference strain, NP_671941 (H77).

The term "hepatitis C virus" ("HCV"), as used herein, refers to any one of a number of different genotypes and isolates of hepatitis C virus. Thus, "HCV" encompasses any of a number of genotypes, subtypes, or quasispecies, of HCV, including, e.g., genotype 1, 2, 3, 4, 6, 7, etc. and subtypes (e.g., 1a, 1b, 2a, 2b, 3a, 4a, 4c, etc.), and quasispecies. Representative HCV genotypes and isolates include: the "Chiron" isolate HCV-1, H77, J6, Con1, isolate 1, BK, EC1, EC10, HC-J2, HC-J5; HC-J6, HC-J7, HC-J8, HC-JT, HCT18, HCT27, HCV-476, HCV-KF, "Hunan", "Japanese", "Taiwan", TH, type 1, type 1a, H77 type 1b, type 1c, type 1d, type 1e, type 1f, type 10, type 2, type 2a, type 2b, type 2c, type 2d, type 2f, type 3, type 3a, type 3b, type 3g, type 4, type 4a, type 4c, type 4d, type 4f, type 4h, type 4k, type 5, type 5a, type 6 and type 6a.

The terms "individual," "host," "subject," and "patient" are used interchangeably herein, and refer to a mammal, including, but not limited to, non-human primates (e.g., simians), equines (e.g., horses), rodents (e.g., rats; mice), and humans.

As used herein, the term "isolated," in reference to a polypeptide, refers to a polypeptide that is in an environment different from that in which the polypeptide naturally occurs. An isolated polypeptide can be purified. By "purified" is meant a compound of interest (e.g., a polypeptide) has been separated from components that accompany it in nature. "Purified" can also be used to refer to a polypeptide separated from components that can accompany it during production of the polypeptide (e.g., during synthesis in vitro, etc.). In some embodiments, a polypeptide (or a mixture of polypeptides) is substantially pure when the polypeptide (or mixture of polypeptides) is at least 60% or at least 75% by weight free from organic molecules with which it is naturally associated or with which it is associated during production. In some embodiments, the polypeptide is from 30% to 60% pure. In some embodiments, the polypeptide (or mixture of polypeptides) is at least 60%, at least 75%, at least 80%, at least 85%, at least 90%, at least 95%, or at least 99%, by weight, pure. For example, in some embodiments, an E1 or an E2 polypeptide (or a mixture of E1 and E2 polypeptides, e.g., an E1/E2 heterodimer) is substantially pure when the E1 or E2 polypeptide (or mixture of E1 and E2 polypeptides) is at least 60% or at least 75% by weight free from organic molecules with which the polypeptide(s) is naturally associated or with which it is associated during production. In some embodiments, the E1 or E2 polypeptide (or mixture of E1 and E2 polypeptides) is at least 60%, at least 75%, at least 80%, at least 85%, at least 90%, at least 95%, or at least 99%, by weight, pure. In some embodiments, where a composition comprises an E2 polypeptide, the E2 polypeptide is at least 60%, at least 75%, at least 80%, at least 85%, at least 90%, at least 95%, or at least 99%, by weight, pure. In some embodiments, where a composition comprises an E1/E2 heterodimeric complex polypeptide, the E1/E2 heterodimeric complex polypeptide is at least 60%, at least 75%, at least 80%, at least 85%, at least 90%, at least 95%, or at least 99%, by weight, pure. In some embodiments, where a composition comprises a T-cell epitope polypeptide, the T-cell epitope polypeptide is at least 60%, at least 75%, at least 80%, at least 85%, at least 90%, at least 95%, or at least 99%, by weight, pure.

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. In some cases, a polynucleotide is RNA. In some cases, a polynucleotide is DNA. A "polynucleotide" includes a nucleic acid that is incorporated into a viral vector or a bacterial vector.

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term "polypeptide" includes glycosylated polypeptides.

The term "heterologous" refers to two components that are defined by structures derived from different sources. For example, where "heterologous" is used in the context of a polypeptide, where the polypeptide includes operably linked amino acid sequences that can be derived from one or more different polypeptides, e.g., amino acid sequences that are not operably linked to the polypeptide in nature. As another example, where a composition comprises an HCV E1/E2 heterodimer and a "heterologous" polypeptide, the "heterologous polypeptide is a polypeptide other than HCV E1 or HCV E2. As another example, where a composition comprises an HCV E1 polypeptide and a "heterologous" polypeptide, the "heterologous polypeptide is a polypeptide other than HCV E1. As another example, where a composition comprises an HCV E2 polypeptide and a "heterologous" polypeptide, the "heterologous" polypeptide is a polypeptide other than HCV E2.

The term "archaeal lipid" refer to a polar lipid common to the Domain Archaea typified by isoprenoid chains in ether linkage to the sn-2,3 carbons of the glycerol backbone.

Archaeal core lipids are most commonly 2,3-di-O-sn-diphytanylglycerol (archaeol), and 2,2',3,3'-tetra-O-dibiphytanyl-sn-diglycerol (caldarchaeol).

Synthetic archaeal lipids or polar synthetic lipids refer to core lipid precursors either derived from Archaeal lipids by hydrolysis or made by chemical synthesis, conjugated to at least one new head group.

Archaeol phospholipids are referred herein to using archaetidyl, for example, AG, archaetidylglycerol; AS, archaetidylserine.

The term "conventional lipids" refers to the lipids common to the Domains Bacteria and Eukarya. This includes polar lipids typified by fatty acyl chains in ester linkage to the sn-1,2 carbons of the glycerol backbone, and neutral lipids such as cholesterol. Conventional phospholipids are referred to in the usual way, for example, DPPG, dipalmitoylphosphatidylglycerol; DPPS, dipalmitoylphosphatidylserine.

The term "archaeosome" refers to a closed lipid vesicle that contains any amount of synthetic archaeal lipid(s).

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "an HCV E1E2 heterodimer" includes a plurality of such heterodimer and reference to "the cyclic dinucleotide" includes reference to one or more cyclic dinucleotides and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides immunogenic compositions comprising: a) hepatitis C virus (HCV) E1E2 heterodimers, HCV E2, or HCV E1; and b) an adjuvant, where the adjuvant is a cyclic dinucleotide or an archaeosome. The present disclosure provides methods of inducing an immune response in an individual to HCV, the methods comprising administering to an individual an effective amount of an immunogenic composition of the present disclosure.

Immunogenic Compositions Comprising HCV E1E2, E2, or E1 Polypeptide+Cyclic Dinucleotide The present disclosure provides an immunogenic composition comprising: a) an HCV E1E2 heterodimer; and b) a cyclic dinucleotide (CDN). The present disclosure provides an immunogenic composition comprising: a) an HCV E2 polypeptide; and b) a CDN. The present disclosure provides an immunogenic composition comprising: a) an HCV E1 polypeptide; and b) a CDN.

In some cases, an immunogenic composition of the present disclosure, when administered to an individual in need thereof, induces an immune response in the individual to one or more HCV genotypes. In some cases, an immunogenic composition of the present disclosure, when administered to an individual in need thereof, induces an immune response in the individual to one or more HCV genotypes, where the immune response is greater than the immune response induced by administration of a control composition comprising the HCV E1/E2 heterodimer (or E1 polypeptide, or E2 polypeptide) but lacking the CDN.

In some cases, an immunogenic composition of the present disclosure, when administered to an individual in need thereof, induces $CD8^+$ CTLs specific for HCV, where the number of HCV-specific $CD8^+$ CTLs induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific $CD8^+$ CTLs induced by administration of a control composition (e.g., a composition comprising the HCV E1/E2 heterodimer but lacking the CDN; a composition comprising an E1 polypeptide but lacking the CDN; a composition comprising an E2 polypeptide but lacking the CDN).

In some cases, an immunogenic composition of the present disclosure, when administered to an individual in need thereof, induces $CD4^+$ T cells specific for HCV, where the number of HCV-specific CD4⁺ T cells induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific CD4⁺ T cells induced by administration of a control composition (e.g., a composition comprising the HCV E1/E2 heterodimer but lacking the CDN; a composition comprising an E1 polypeptide but lacking the CDN; a composition comprising an E2 polypeptide but lacking the CDN).

In some cases, an immunogenic composition of the present disclosure, when administered to an individual in need thereof, induces production of HCV-specific CD4⁺ T cells and CD8⁺ T cells in the individual, where the number of HCV-specific CD4⁺ T cells and/or CD8⁺ T cells is increased, such that the percent of total peripheral CD4⁺ and/or CD8⁺ T cells that is HCV-specific is from 0.01% to 0.05%, from 0.05% to 0.10%, from 0.10% to 0.125%, from 0.125% to 0.25%, from 0.25% to from 0.50%, or 0.5% to 10% (e.g., from 0.5% to 1%, from 1% to 2%, from 2% to 5%, or from 5% to 10%). The number of HCV-specific CD4⁺ T cells and CD8⁺ T cells in a control individual (e.g., an individual not infected with HCV) not treated with the immunogenic composition would be undetectable.

In some cases, an immunogenic composition of the present disclosure, when administered to an individual in need thereof, increases the number of HCV E1/E2-specific CD4⁺ T cells and CD8⁺ T cells in the individual by at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, compared to the number of HCV E1/E2-specific CD4⁺ T cells and CD8⁺ T cells in the individual induced by administration of a control composition comprising the HCV E1/E2 heterodimer (or HCV E2 polypeptide, or HCV E1 polypeptide) but lacking the CDN, or compared to the number of HCV E1/E2-specific CD4⁺ T cells and CD8⁺ T cells in the individual before administration of the immunogenic composition.

In some cases, an immunogenic composition of the present disclosure, when administered to an individual in need thereof, induces helper T lymphocytes (e.g., CD4⁺ T cells) specific for HCV, where the number of HCV-specific helper T lymphocytes induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific helper T cells induced by administration of a control composition comprising the HCV E1/E2 heterodimer (or HCV E2 polypeptide, or HCV E1 polypeptide) but lacking the CDN, or compared to the number of HCV-specific CD4⁺ T cells in the individual before administration of the immunogenic composition.

In some cases, an immunogenic composition of the present disclosure, when administered to an individual in need thereof, induces antibody specific for HCV, where the level of HCV-specific antibody induced is at least at high as the level of HCV-specific antibody induced by administration of a control composition comprising the HCV E1/E2 heterodimer (or HCV E2 polypeptide, or HCV E1 polypeptide) but lacking the CDN.

In some cases, an immunogenic composition of the present disclosure, when administered to an individual in need thereof, induces antibody specific for HCV, where the level of HCV-specific antibody induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the level of HCV-specific antibody induced by administration of a control composition comprising the HCV E1/E2 heterodimer (or HCV E2 polypeptide, or HCV E1 polypeptide) but lacking the CDN, or compared the level of HCV-specific antibody in the individual before administration of the immunogenic composition.

An immunogenic composition of the present disclosure, when administered to an individual in need thereof, induces an immune response (e.g., a cellular immune response) in the individual to one or more HCV genotypes. In some cases, an immunogenic composition of the present disclosure, when administered to an individual in need thereof, induces an immune response in the individual to HCV genotype 1. In some cases, an immunogenic composition of the present disclosure, when administered to an individual in need thereof, induces an immune response in the individual to HCV genotype 2. In some cases, an immunogenic composition of the present disclosure when administered to an individual in need thereof, induces an immune response in the individual to HCV genotype 3. In some cases, an immunogenic composition of the present disclosure, when administered to an individual in need thereof, induces an immune response in the individual to HCV genotype 1 and HCV genotype 3. In some cases, an immunogenic composition of the present disclosure, when administered to an individual in need thereof, induces an immune response in the individual to HCV genotype 1, HCV genotype 2, and HCV genotype 3. In some cases, an immunogenic composition of the present disclosure, when administered to an individual in need thereof, induces an immune response in the individual to HCV genotype 1, HCV genotype 2, HCV genotype 3, and HCV genotype 7. In some cases, an immunogenic composition of the present disclosure, when administered to an individual in need thereof, induces an immune response in the individual to HCV genotype 1, HCV genotype 2, HCV genotype 3, HCB genotype 4, HCV genotype 5, HCV genotype 6, and HCV genotype 7.

HCV E1/E2 Heterodimers; HCV E2 Polypeptides; HCV E1 Polypeptides

HCV E1/E2 heterodimers suitable for use in an immunogenic composition of the present disclosure include HCV E1/E2 heterodimers comprising wild-type HCV E1 polypeptides; HCV E1/E2 heterodimers comprising wild-type HCV E2 polypeptides; HCV E1/E2 heterodimers comprising variant HCV E1 polypeptides; and HCV E1/E2 heterodimers comprising variant HCV E2 polypeptides. HCV E2 polypeptides suitable for use in an immunogenic composition of the present disclosure include wild-type E2 polypeptides and variant E2 polypeptides. HCV E1 polypeptides suitable for use in an immunogenic composition of the present disclosure include wild-type E1 polypeptides and variant E1 polypeptides.

E2 Polypeptides

An E2 polypeptide suitable for inclusion in an E1/E2 heterodimer for inclusion in an immunogenic composition of the present disclosure, or for inclusion by itself in an immunogenic composition of the present disclosure, can have a length of from about 200 amino acids (aa) to about 250 aa, from about 250 aa to about 275 aa, from about 275 aa to about 300 aa, from about 300 aa to about 325 aa, from about 325 aa to about 350 aa, or from about 350 aa to about 365 aa. In some cases, an HCV E2 polypeptide suitable for inclusion in an immunogenic composition of the present disclosure is an HCV E2 ectodomain polypeptide. In some cases, an HCV E2 polypeptide suitable for inclusion in an immunogenic composition of the present disclosure is a full-length HCV E2 polypeptide.

Figure 1A:
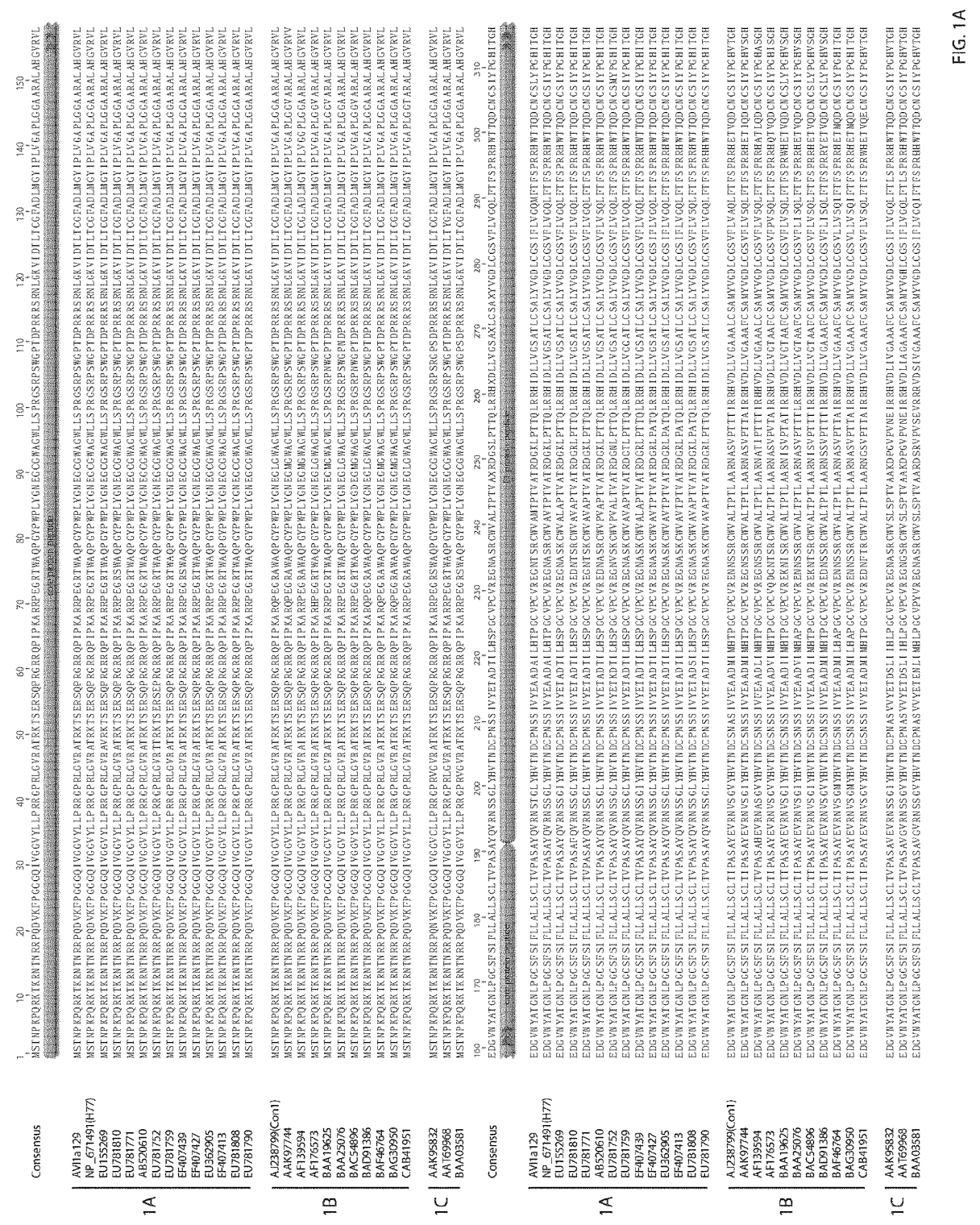
Figure 2B:
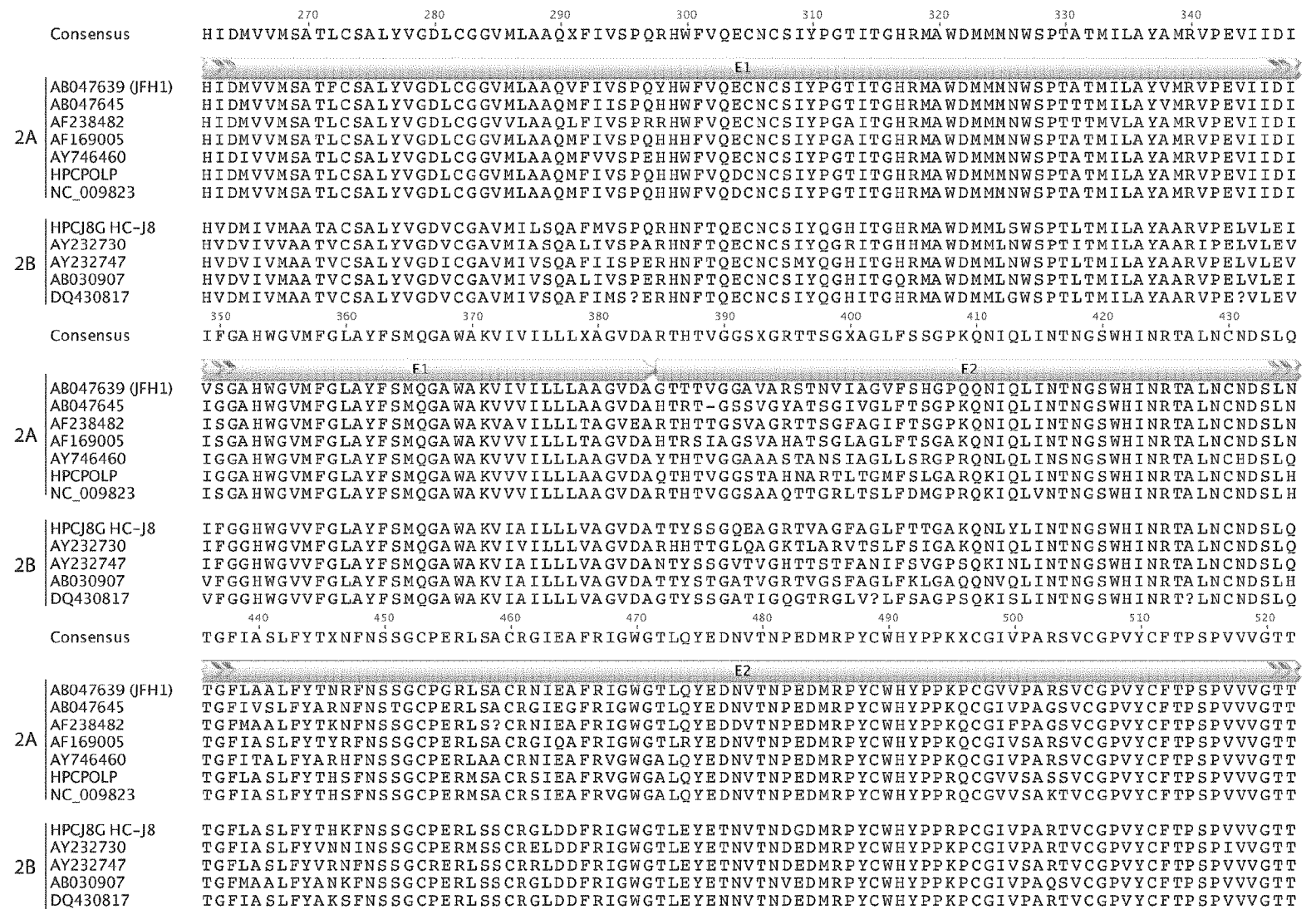
Figure 3B:
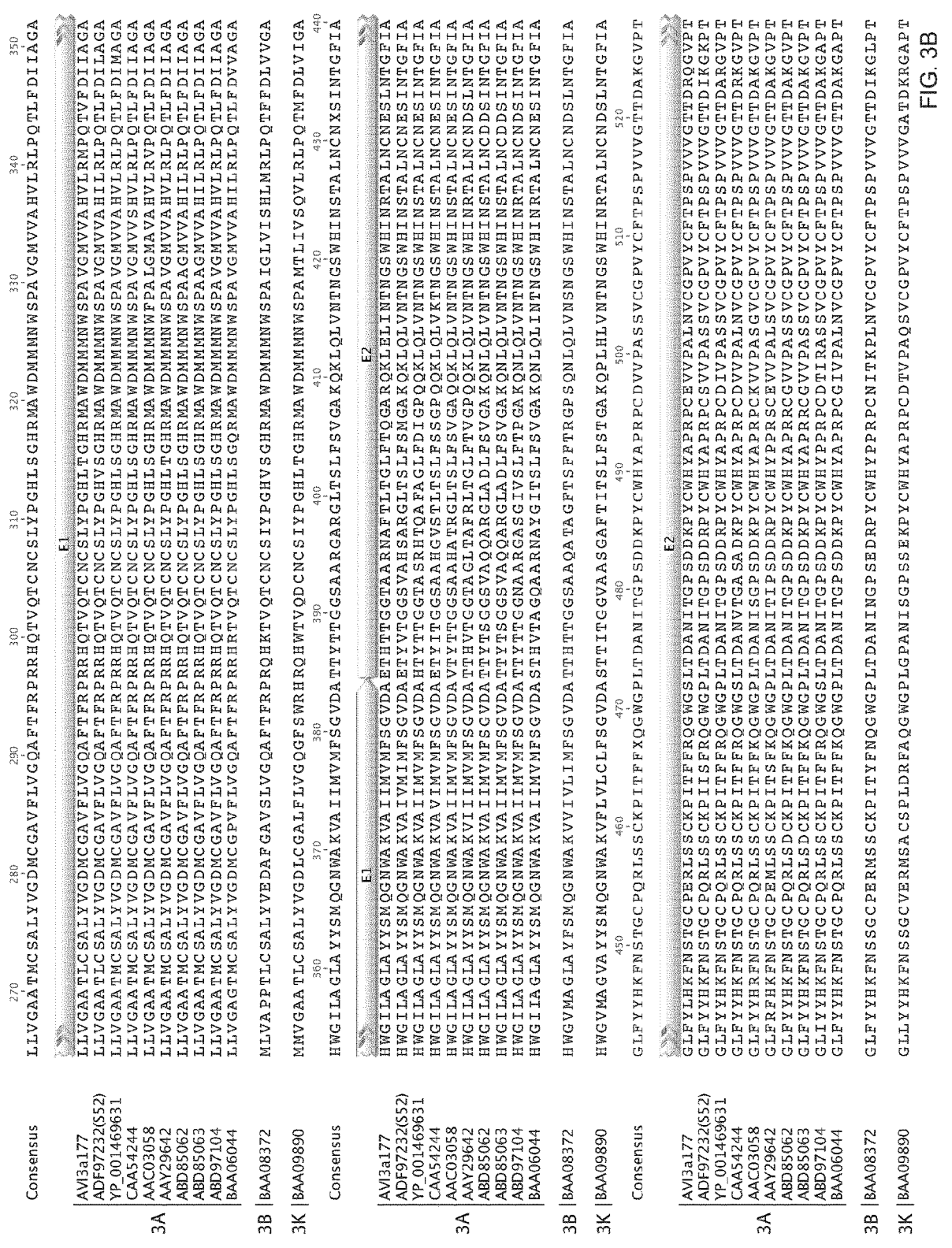
Figure 3C:
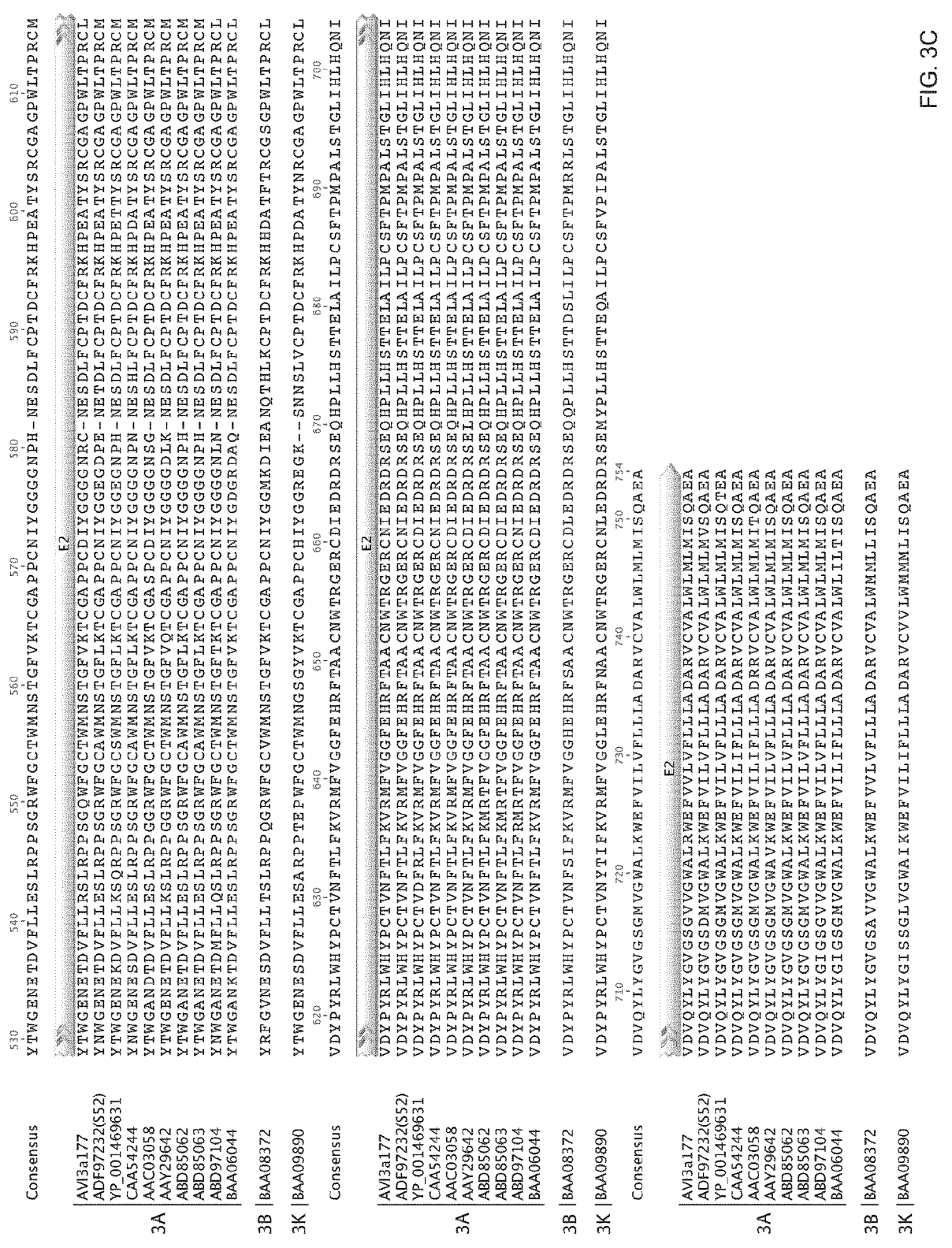
Figure 4B:
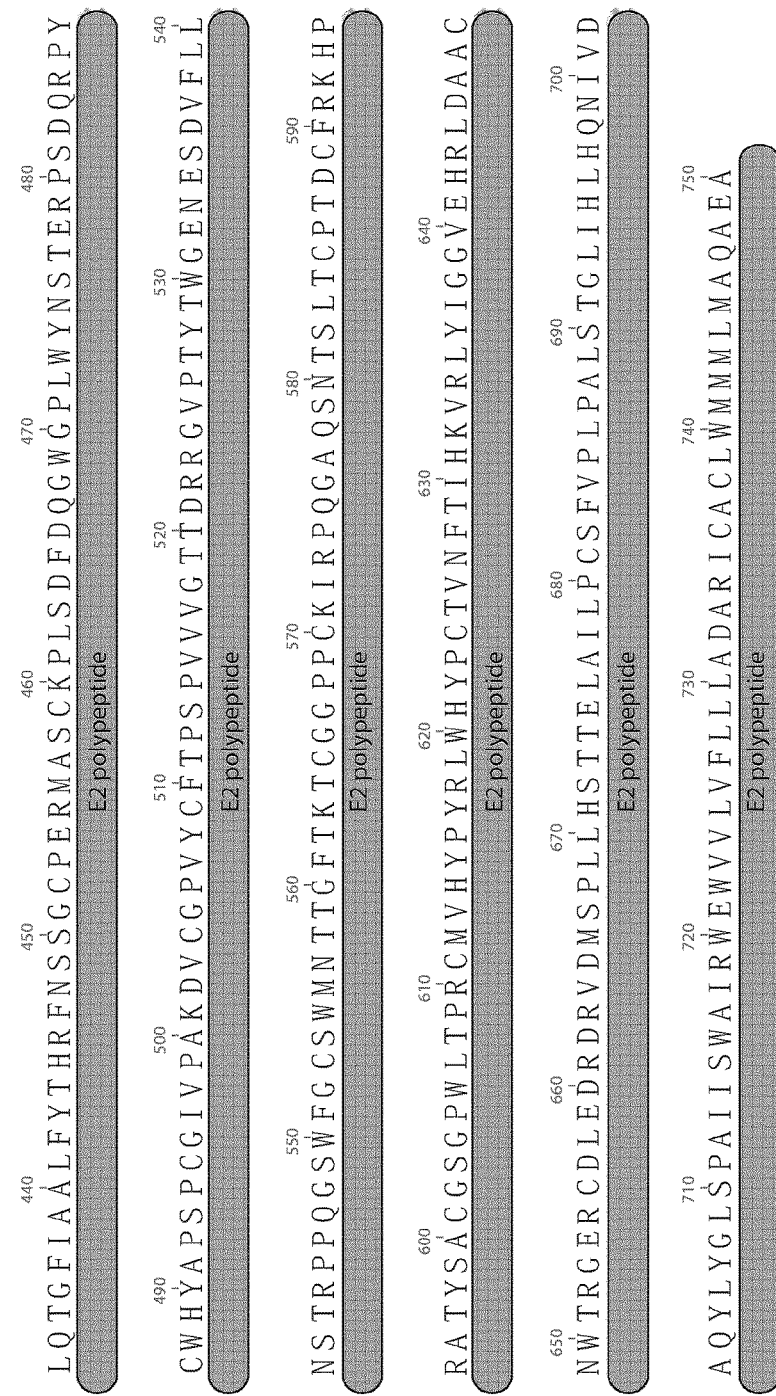

In FIG. 1A-AC, the amino acid sequence of E2 is amino acid 384 to amino acid 746. In FIG. 2A-2B, the amino acid sequence of E2 is amino acid 384 to amino acid 751. In FIG. 3A-3C, the amino acid sequence of E2 is amino acid 385 to amino acid 754. In FIG. 4A-4B, the amino acid sequence of E2 is amino acid 384 to amino acid 750. As used herein, an "E2 polypeptide" includes a precursor E2 protein, including the signal sequence; includes a mature E2 polypeptide which lacks this sequence; and includes an E2 polypeptide with a heterologous signal sequence. An E2 polypeptide can include a C-terminal membrane anchor sequence which occurs at approximately amino acid positions 715-730 and may extend as far as approximately amino acid residue 746 (see, Lin et al., J. Virol. (1994) 68:5063-5073).

Figure 1B:
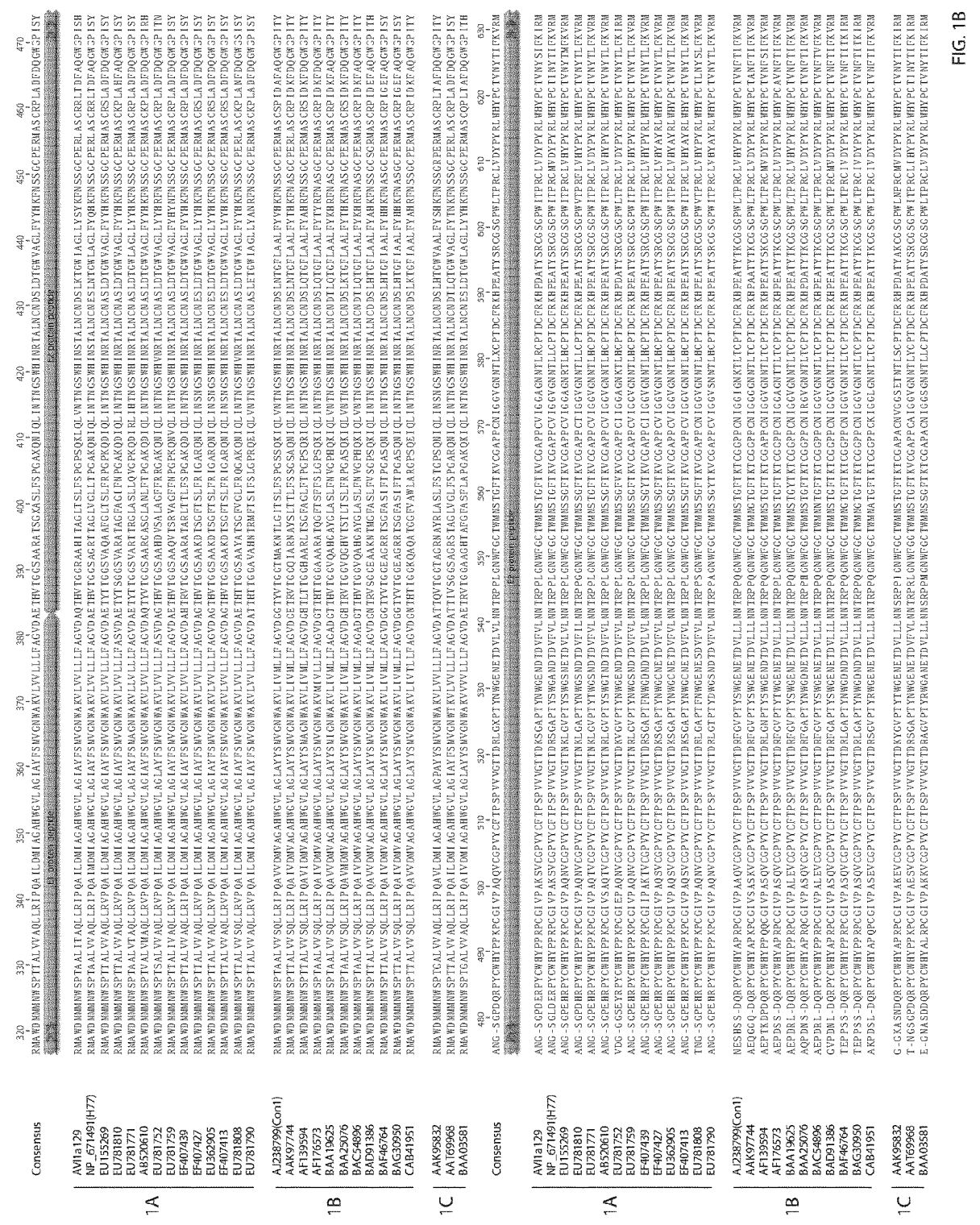
Figure 1C:
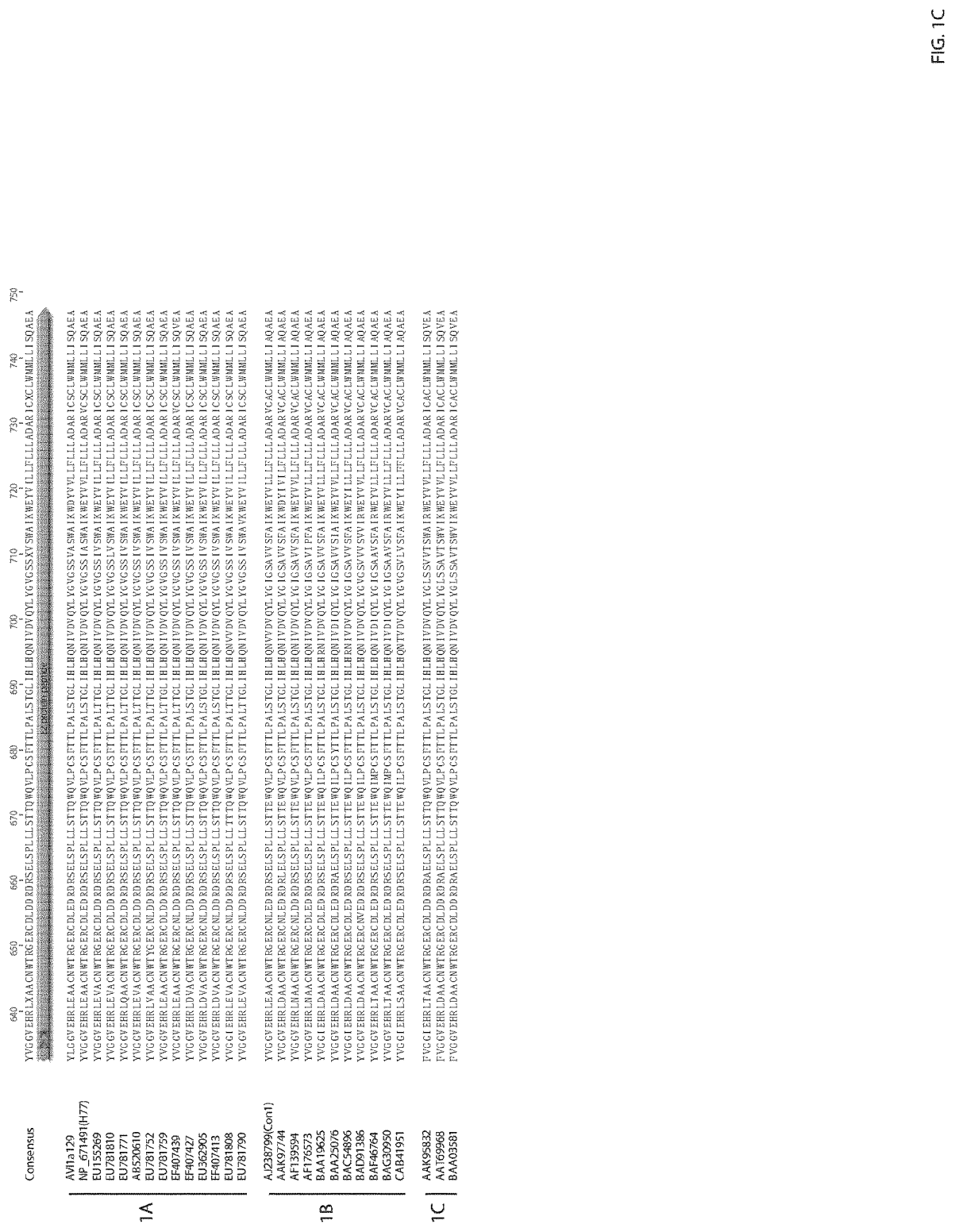

In some cases, a E2 polypeptide suitable for inclusion in an immunogenic composition of the present disclosure lacks a portion of its C-terminal region, e.g., from about amino acid 715 to the C-terminus; from about amino acid 625 to the C-terminus; from about amino acid 661 to the C-terminus; from about amino acid 655 to the C-terminus; from about amino acid 500 to the C-terminus, where the amino acid numbering is with reference to the numbering in FIG. 1A-1C. See, e.g., U.S. Pat. No. 6,521,423.

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIG. 1A-1C, FIG. 2A-2C, FIG. 3A-3C, or FIG. 4A-4B. An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, or at least about 75%, amino acid sequence identity to an amino acid sequence of an E2 polypeptide depicted in FIG. 1A-1C, FIG. 2A-2C, FIG. 3A-3C, or FIG. 4A-4B.

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIG. 1A-1C. For example, an E2 polypeptide of genotype 1 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIG. 1A-1C. For example, an E2 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1A and depicted in FIG. 1A-1C. For example, an E2 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1B and depicted in FIG. 1A-1C. For example, an E2 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1C and depicted in FIG. 1A-1C.

Figure 2C:
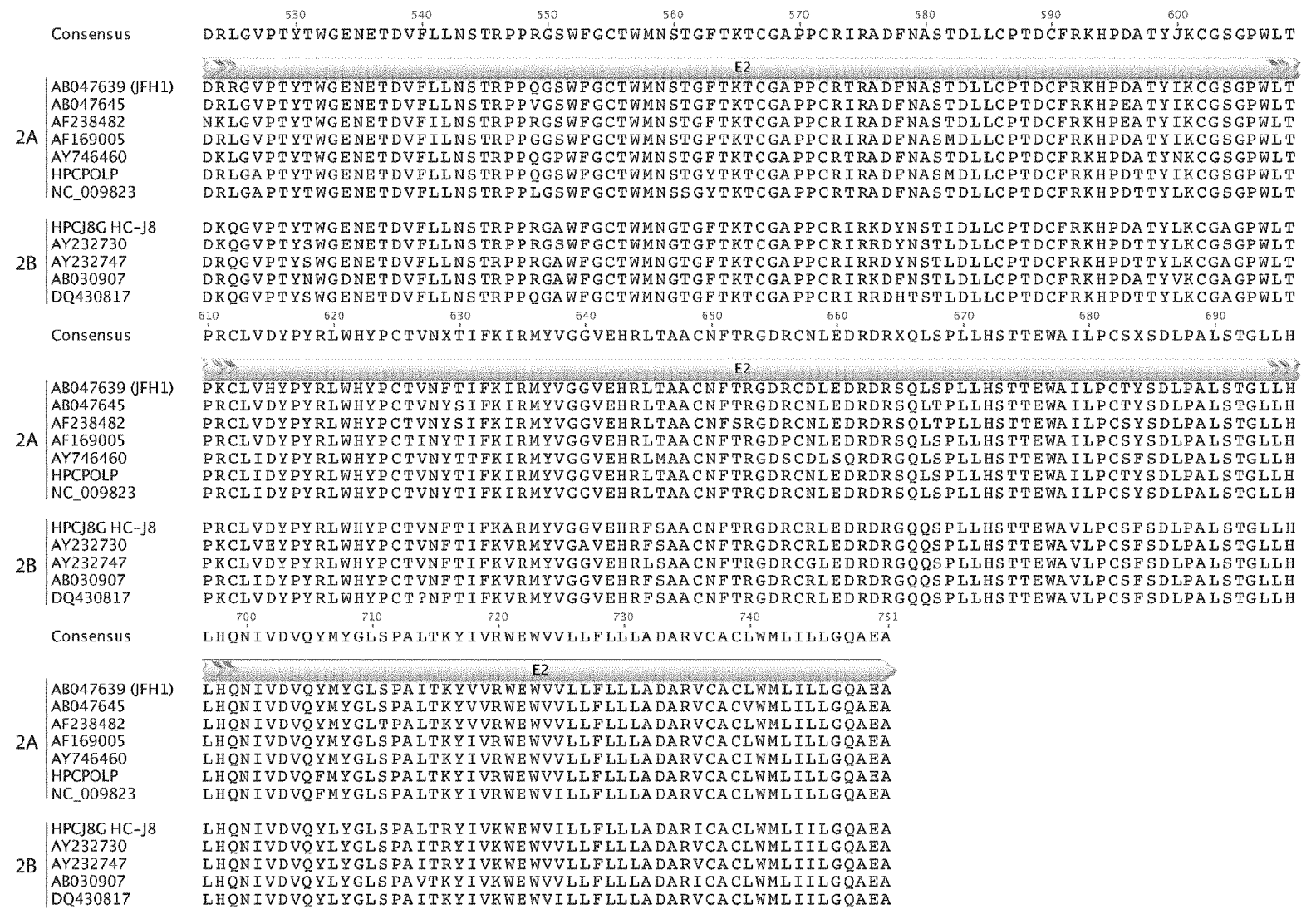

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIG. 2A-2C. For example, an E2 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of an amino acid sequence depicted in FIG. 2A-2C. For example, an E2 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIG. 2A-2C. For example, an E2 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIG. 2A-2C.

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIG. 3A-3C. For example, an E2 polypeptide of genotype 3 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence depicted in FIG. 3A-3C. For example, an E2 polypeptide of genotype 3A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence identified as 3A and depicted in FIG. 3A-3C. For example, an E2 polypeptide of genotype 3B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3B and depicted in FIG. 3A-3C. For example, an E2 polypeptide of genotype 3K can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3K and depicted in FIG. 3A-3C.

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the amino acid sequence of the E2 polypeptide depicted in FIG. 4A-4B. For example, an E2 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-750 of the amino acid sequence depicted in FIG. 4A-4B.

E1 Polypeptides

An HCV E1 polypeptide suitable for inclusion in an E1/E2 heterodimer for inclusion in an immunogenic composition of the present disclosure, or for inclusion by itself in an immunogenic composition of the present disclosure, can have a length of from about 100 amino acids (aa) to about 150 aa, from about 150 aa to about 175 aa, from about 175 aa to about 195 aa, from about 131 aa to about 175 aa, or from about 175 aa to about 193 aa. In some cases, an HCV E1 polypeptide suitable for inclusion in an E1/E2 heterodimer present in an immunogenic composition of the present disclosure is an HCV E1 ectodomain polypeptide. In some cases, an HCV E1 polypeptide suitable for inclusion in an E1/E2 heterodimer present in an immunogenic composition of the present disclosure is a full-length HCV E1 polypeptide.

In FIG. 1A-1C, the amino acid sequence of E1 is amino acid 192 to amino acid 383. In FIG. 2A-2C, the amino acid sequence of E1 is amino acid 192 to amino acid 383. In FIG. 3A-3C, the amino acid sequence of E1 is amino acid 192 to amino acid 384. In FIG. 4A-4B, the amino acid sequence of E1 is amino acid 192 to amino acid 383. Amino acids at around 170 through approximately 191 serve as a signal sequence for E1. As used herein, "E1 polypeptide" includes a precursor E1 protein, including the signal sequence; includes a mature E1 polypeptide which lacks this sequence; and includes an E1 polypeptide with a heterologous signal sequence. An E1 polypeptide can include a C-terminal membrane anchor sequence which occurs at approximately amino acid positions 360-383 (see, e.g., WO 96/04301). In some cases, a suitable E1 polypeptide lacks a C-terminal portion that includes a transmembrane region. For example, in some cases, a suitable E1 polypeptide lacks the C-terminal portion from amino acid 330 to amino acid 384, or from amino acid 360 to amino acid 384. E1 polypeptides can be an E1 polypeptide of any genotype, subtype or isolate of HCV. E1 polypeptides of genotype 1 and E1 polypeptides of genotype 3 are included in an E1/E2 heterodimer of the present disclosure.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIG. 1A-1C, FIG. 2A-2C, FIG. 3A-3C, or FIG. 4A-4B.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIG. 1A-1C. For example, an E1 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1A and depicted in FIG. 1A-1C. For example, an E1 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1B and depicted in FIG. 1A-1C. For example, an E1 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1C and depicted in FIG. 1A-1C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIG. 2A-2C. For example, an E1 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2A and depicted in FIG. 2A-2C. For example, an E1 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2B and depicted in FIG. 2A-2C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the consensus E1 polypeptide amino acid sequence depicted in FIG. 3A-3C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIG. 4A-4B. For example, an E1 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of the amino acid sequence depicted in FIGS. 4A-4B.

HCV E1 and E2 Polypeptides Comprising Amino Acids from a Proteolytically Cleavable Linker As described in more detail below, an HCV E1/E2 heterodimer can be generated using a method that involves an HCV E1 or an HCV E2 polypeptide comprising a heterologous proteolytically cleavable linker. Following enzymatic cleavage of the proteolytically cleavable linker, from 1 to 6 (e.g., 1, 2, 3, 4, 5, or 6) heterologous amino acids can remain on the HCV E1 or E2 polypeptide. For example, from 1 to 6 (e.g., 1, 2, 3, 4, 5, or 6) heterologous amino acids can remain at the N-terminus of an HCV E2 polypeptide. As another example, from 1 to 6 (e.g., 1, 2, 3, 4, 5, or 6) heterologous amino acids can remain at the C-terminus of an HCV E2 polypeptide. As another example, from 1 to 6 (e.g., 1, 2, 3, 4, 5, or 6) heterologous amino acids can remain at the N-terminus of an HCV E1 polypeptide. As another example, from 1 to 6 (e.g., 1, 2, 3, 4, 5, or 6) heterologous amino acids can remain at the C-terminus of an HCV E1 polypeptide.

In some cases, amino acids C-terminal to the proteolytic cleavage site in a proteolytically cleavable linker are Gly-Pro, Ser, Gly, or Gly-Ser. Thus, in some cases, a modified HCV E1 polypeptide comprises, appended to the N-terminus of an HCV E1 polypeptide: Gly-Pro, Ser, Gly, or Gly-Ser. In other words, in some cases, a modified HCV E1 polypeptide comprises, in order from N-terminus to C-terminus: a) Gly-Pro, Ser, Gly, or Gly-Ser; and b) an HCV E1 polypeptide.

In some cases, amino acids C-terminal to the proteolytic cleavage site in a proteolytically cleavable linker are Gly-Pro, Ser, Gly, or Gly-Ser. Thus, in some cases, a modified HCV E2 polypeptide comprises, appended to the N-terminus of an HCV E2 polypeptide: Gly-Pro, Ser, Gly, or Gly-Ser. In other words, in some cases, a modified HCV E2 polypeptide comprises, in order from N-terminus to C-terminus: a) Gly-Pro, Ser, Gly, or Gly-Ser; and b) an HCV E2 polypeptide.

In some cases, amino acids N-terminal to the proteolytic cleavage site in a proteolytically cleavable linker are LEVLFQ (SEQ ID NO:122), ENLYYFQ (SEQ ID NO:150), LVPR (SEQ ID NO:124), I(E/D)GR (SEQ ID NO:125), or DDDDK (SEQ ID NO:123). Thus, in some cases, a modified HCV E1 polypeptide comprises, appended to the C-terminus of an HCV E1 polypeptide: LEVLFQ (SEQ ID NO:122), ENLYYFQ (SEQ ID NO:150), LVPR (SEQ ID NO:124), I(E/D)GR (SEQ ID NO:125), or DDDDK (SEQ ID NO:123). In other words, in some cases, a modified HCV E1 polypeptide comprises, in order from N-terminus to C-terminus: a) an HCV E1 polypeptide; and b) LEVLFQ (SEQ ID NO:122), ENLYYFQ (SEQ ID NO:150), LVPR (SEQ ID NO:124), I(E/D)GR (SEQ ID NO:125), or DDDDK (SEQ ID NO:123).

In some cases, amino acids N-terminal to the proteolytic cleavage site in a proteolytically cleavable linker are LEVLFQ (SEQ ID NO:122), ENLYYFQ (SEQ ID NO:150), LVPR (SEQ ID NO:124), I(E/D)GR (SEQ ID NO:125), or DDDDK (SEQ ID NO:123). Thus, in some cases, a modified HCV E2 polypeptide comprises, appended to the C-terminus of an HCV E2 polypeptide: LEVLFQ (SEQ ID NO:122), ENLYYFQ (SEQ ID NO:150), LVPR (SEQ ID NO:124), I(E/D)GR (SEQ ID NO:125), or DDDDK (SEQ ID NO:123). In other words, in some cases, a modified HCV E2 polypeptide comprises, in order from N-terminus to C-terminus: a) an HCV E2 polypeptide; and b) LEVLFQ (SEQ ID NO:122), ENLYYFQ (SEQ ID NO:150), LVPR (SEQ ID NO:124), I(E/D)GR (SEQ ID NO:125), or DDDDK (SEQ ID NO:123).

In some cases, a flexible linker of from 1 to 10 amino acids is interposed between the proteolytically cleavable linker and the HCV E1 or E2 polypeptide. Flexible linkers are intrinsically disordered flexible linker domains or loops that vary in length and can be rich in polar uncharged amino acids. Flexible linkers include, e.g., glycine polymers $(G)_n$, glycine-serine polymers (including, for example, $(GS)_n$, $GSGGS_n$ (SEQ ID NO:108), $GGSGGS_n$ (SEQ ID NO:109), and $GGGS_n$ (SEQ ID NO:110), where n is an integer of at least one, e.g., where n is 1, 2, 3, 4, 5, or 6); glycine-alanine polymers, such as GAGAGAGA and the like; and alanine-serine polymers, e.g., SASASASA and the like. Exemplary linkers can comprise amino acid sequences including, but not limited to, GGSG (SEQ ID NO:111), GGSGG (SEQ ID NO:112), GSGSG (SEQ ID NO:113), GSGGG (SEQ ID NO:114), GGGSG (SEQ ID NO:115), GSSSG (SEQ ID NO:116), and the like.

For example, in some cases, a modified E1 polypeptide comprises, in order from N-terminus to C-terminus: a) Gly-Pro, Ser, Gly, or Gly-Ser; b) a flexible linker of from 1 to 10 amino acids; and c) an HCV E1 polypeptide.

As another example, in some cases, a modified E2 polypeptide comprises, in order from N-terminus to C-terminus: a) Gly-Pro, Ser, Gly, or Gly-Ser; b) a flexible linker of from 1 to 10 amino acids; and c) an HCV E2 polypeptide.

As another in some cases, a modified E1 polypeptide comprises, from N-terminus to C-terminus: a) an HCV E1 polypeptide; b) a flexible linker of from 1 to 10 amino acids; and c) LEVLFQ (SEQ ID NO:122), ENLYYFQ (SEQ ID NO:150), LVPR (SEQ ID NO:124), I(E/D)GR (SEQ ID NO:125), or DDDDK (SEQ ID NO:123).

As another in some cases, a modified E2 polypeptide comprises, from N-terminus to C-terminus: a) an HCV E2 polypeptide; b) a flexible linker of from 1 to 10 amino acids; and c) LEVLFQ (SEQ ID NO:122), ENLYYFQ (SEQ ID NO:150), LVPR (SEQ ID NO:124), I(E/D)GR (SEQ ID NO:125), or DDDDK (SEQ ID NO:123).

E2 with N-Terminal Heterologous Amino Acids

In some cases, an HCV E1/E2 heterodimer suitable for inclusion in an immunogenic composition of the present disclosure comprises a modified HCV E2 polypeptide with from 1 to 6 amino acids from the proteolytically cleavable linker on the N-terminus of the E2 polypeptide. In some cases, an HCV E1/E2 heterodimer suitable for inclusion in an immunogenic composition of the present disclosure comprises: a) an HCV E1 polypeptide; and b) a modified E2 polypeptide comprising, in order from N-terminus to C-terminus: i) from 1 to 6 heterologous amino acids wherein the from 1 to 6 heterologous amino acids are C-terminal to a site of proteolytic cleavage in a proteolytically cleavable linker; and ii) an HCV E2 polypeptide.

Proteolytically cleavable linkers are described elsewhere herein. Following proteolytic cleavage of a precursor polypeptide, as described herein, a modified E2 polypeptide is generated, which modified E2 polypeptide comprises, at its N-terminus, amino acids C-terminal to the protease cleavage site within the proteolytically cleavable linker.

For example, where the proteolytically cleavable linker comprises a PreScission cleavage site (LEVLFQGP; SEQ ID NO:117), where cleavage occurs between the glutamine and the glycine, a modified E2 polypeptide present in a heterodimeric E1/E2 polypeptide suitable for inclusion in an immunogenic composition of the present disclosure comprises, in order from N-terminus to C-terminus: a) Gly-Pro; and b) an HCV E2 polypeptide. As another example, where the proteolytically cleavable linker comprises a TEV cleavage site (ENLYFQS; SEQ ID NO:118), where cleavage occurs between the glutamine and the serine, a modified E2 polypeptide present in a heterodimeric E1/E2 polypeptide suitable for inclusion in an immunogenic composition of the present disclosure comprises, in order from N-terminus to C-terminus: a) Ser; and b) an HCV E2 polypeptide.

As another example, where the proteolytically cleavable linker comprises a TEV cleavage site (ENLYFQG; SEQ ID NO:119), where cleavage occurs between the glutamine and the glycine, a modified E2 polypeptide present in a heterodimeric E1/E2 polypeptide suitable for inclusion in an immunogenic composition of the present disclosure comprises, in order from N-terminus to C-terminus: a) Gly; and b) an HCV E2 polypeptide.

As another example, where the proteolytically cleavable linker comprises a thrombin cleavage site (LVPRGS; SEQ ID NO:120), where cleavage occurs between the arginine and the glycine, a modified E2 polypeptide present in a heterodimeric E1/E2 polypeptide suitable for inclusion in an immunogenic composition of the present disclosure comprises, in order from N-terminus to C-terminus: a) Gly-Ser; and an HCV E2 polypeptide.

As another example, where the proteolytically cleavable linker comprises a Factor Xa cleavage site (I(E/D)GRX, where X is any amino acid except arginine or proline; SEQ ID NO:121), where cleavage occurs between the arginine and the X, a modified E2 polypeptide present in a heterodimeric E1/E2 polypeptide suitable for inclusion in an immunogenic composition of the present disclosure comprises, in order from N-terminus to C-terminus: a) X (where X is any amino acid except arginine or proline); and an HCV E2 polypeptide.

Thus, for example, in some cases, an HCV E1/E2 heterodimer suitable for inclusion in an immunogenic composition of the present disclosure comprises: a) an HCV E1 polypeptide; and b) a modified E2 polypeptide comprising, in order from N-terminus to C-terminus: i) from 1 to 6 heterologous amino acids, wherein the from 1 to 6 (e.g., 1, 2, 3, 4, 5, or 6) heterologous amino acids are C-terminal to a site of proteolytic cleavage in a proteolytically cleavable linker; and ii) an HCV E2 polypeptide. In some cases, the 1 to 6 heterologous amino acids are Gly-Pro. In some cases, the 1 to 6 heterologous amino acids is Ser. In some cases, the 1 to 6 heterologous amino acids is Gly. In some cases, the 1 to 6 heterologous amino acids are Gly-Ser.

As another example, in some cases, an HCV E1/E2 heterodimer suitable for inclusion in an immunogenic composition of the present disclosure comprises: a) an HCV E2 polypeptide; and b) a modified E1 polypeptide comprising, in order from N-terminus to C-terminus: i) from 1 to 6 heterologous amino acids, wherein the from 1 to 6 (e.g., 1, 2, 3, 4, 5, or 6) heterologous amino acids are C-terminal to a site of proteolytic cleavage in a proteolytically cleavable linker; and ii) an HCV E1 polypeptide. In some cases, the 1 to 6 heterologous amino acids are Gly-Pro. In some cases, the 1 to 6 heterologous amino acids is Ser. In some cases, the 1 to 6 heterologous amino acids is Gly. In some cases, the 1 to 6 heterologous amino acids are Gly-Ser.

E1 with N-Terminal Heterologous Amino Acids

In some cases, an HCV E1/E2 heterodimer suitable for inclusion in an immunogenic composition of the present disclosure comprises a modified HCV E1 polypeptide with from 1 to 6 amino acids from a proteolytically cleavable linker on the N-terminus of the E1 polypeptide. In some cases, an HCV E1/E2 heterodimer suitable for inclusion in an immunogenic composition of the present disclosure comprises: a) an HCV E2 polypeptide; and b) a modified E1 polypeptide comprising, in order from N-terminus to C-terminus: i) from 1 to 6 heterologous amino acids wherein the from 1 to 6 heterologous amino acids are C-terminal to a site of proteolytic cleavage in a proteolytically cleavable linker; and ii) an HCV E1 polypeptide.

Proteolytically cleavable linkers are described elsewhere herein. Following proteolytic cleavage of a precursor polypeptide (e.g., a precursor polypeptide comprising, in order from N-terminus to C-terminus: a) an Fc polypeptide or an HCV E2 polypeptide; b) a proteolytically cleavable linker; and c) an HCV E1 polypeptide), a modified E1 polypeptide is generated, which modified E1 polypeptide comprises, at its N-terminus, amino acids C-terminal to the protease cleavage site within the proteolytically cleavable linker.

For example, where the proteolytically cleavable linker comprises a PreScission cleavage site (LEVLFQGP; SEQ ID NO:117), where cleavage occurs between the glutamine and the glycine, a modified E1 polypeptide present in an HCV E1/E2 heterodimer suitable for inclusion in an immunogenic composition of the present disclosure comprises, in order from N-terminus to C-terminus: a) Gly-Pro; and b) an HCV E1 polypeptide.

As another example, where the proteolytically cleavable linker comprises a TEV cleavage site (ENLYFQS; SEQ ID NO:118), where cleavage occurs between the glutamine and the serine, a modified E1 polypeptide present in an HCV E1/E2 heterodimer suitable for inclusion in an immunogenic composition of the present disclosure comprises, in order from N-terminus to C-terminus: a) Ser; and b) an HCV E1 polypeptide.

As another example, where the proteolytically cleavable linker comprises a TEV cleavage site (ENLYFQG; SEQ ID NO:119), where cleavage occurs between the glutamine and the glycine, a modified E1 polypeptide present in an HCV E1/E2 heterodimer suitable for inclusion in an immunogenic composition of the present disclosure comprises, in order from N-terminus to C-terminus: a) Gly; and b) an HCV E1 polypeptide.

As another example, where the proteolytically cleavable linker comprises a thrombin cleavage site (LVPRGS; SEQ ID NO:120), where cleavage occurs between the arginine and the glycine, a modified E1 polypeptide present in an HCV E1/E2 heterodimer suitable for inclusion in an immunogenic composition of the present disclosure comprises, in order from N-terminus to C-terminus: a) Gly-Ser; and an HCV E1 polypeptide.

As another example, where the proteolytically cleavable linker comprises a Factor Xa cleavage site (I(E/D)GRX, where X is any amino acid except arginine or proline; SEQ ID NO:121), where cleavage occurs between the arginine and the X, a modified E1 polypeptide present in an HCV E1/E2 heterodimer suitable for inclusion in an immunogenic composition of the present disclosure comprises, in order from N-terminus to C-terminus: a) X (where X is any amino acid except arginine or proline); and an HCV E1 polypeptide.

E2 with C-Terminal Heterologous Amino Acids

In some cases, an HCV E1/E2 heterodimer suitable for inclusion in an immunogenic composition of the present disclosure comprises a modified HCV E2 polypeptide with from 1 to 6 amino acids from a proteolytically cleavable linker on the C-terminus of the E2 polypeptide. In some cases, an HCV E1/E2 heterodimer suitable for inclusion in an immunogenic composition of the present disclosure comprises: a) an HCV E1 polypeptide; and b) a modified E2 polypeptide comprising, in order from N-terminus to C-terminus: i) an HCV E2 polypeptide; and ii) from 1 to 6 heterologous amino acids wherein the from 1 to 6 heterologous amino acids are N-terminal to a site of proteolytic cleavage in a proteolytically cleavable linker.

Proteolytically cleavable linkers are described elsewhere herein. Following proteolytic cleavage of a precursor polypeptide (e.g., a precursor polypeptide comprising, in order from N-terminus to C-terminus: a) HCV E2 polypeptide; b) a proteolytically cleavable linker; and c) an Fc polypeptide or an HCV E1 polypeptide), a modified E2 polypeptide is generated, which modified E2 polypeptide comprises, at its C-terminus, amino acids N-terminal to the protease cleavage site within the proteolytically cleavable linker.

For example, where the proteolytically cleavable linker comprises a PreScission cleavage site (LEVLFQGP; SEQ ID NO:117), where cleavage occurs between the glutamine and the glycine, a modified E2 polypeptide present in an HCV E1/E2 heterodimer suitable for inclusion in an immunogenic composition of the present disclosure comprises, in order from N-terminus to C-terminus: a) an HCV E2 polypeptide; and b) LEVLFQ (SEQ ID NO:122).

As another example, where the proteolytically cleavable linker comprises an enterokinase cleavage site (DDDDK; SEQ ID NO:123), where cleavage occurs C-terminal to the Lys, a modified E2 polypeptide present in an HCV E1/E2 heterodimer suitable for inclusion in an immunogenic composition of the present disclosure comprises, in order from N-terminus to C-terminus: a) an HCV E2 polypeptide; and b) DDDDK (SEQ ID NO:123).

As another example, where the proteolytically cleavable linker comprises a TEV cleavage site (ENLYFQG; SEQ ID NO:119), where cleavage occurs between the glutamine and the glycine, a modified E2 polypeptide present in an HCV E1/E2 heterodimer suitable for inclusion in an immunogenic composition of the present disclosure comprises, in order from N-terminus to C-terminus: a) an HCV E2 polypeptide; and b) ENLYFQ (SEQ ID NO:151).

As another example, where the proteolytically cleavable linker comprises a thrombin cleavage site (LVPRGS; SEQ ID NO:120), where cleavage occurs between the arginine and the glycine, a modified E2 polypeptide present in an HCV E1/E2 heterodimer suitable for inclusion in an immunogenic composition of the present disclosure comprises, in order from N-terminus to C-terminus: a) an HCV E2 polypeptide; and LVPR (SEQ ID NO:124).

As another example, where the proteolytically cleavable linker comprises a Factor Xa cleavage site (I(E/D)GRX, where X is any amino acid except arginine or proline; SEQ ID NO:121), where cleavage occurs between the arginine and the X, a modified E2 polypeptide present in an HCV E1/E2 heterodimer suitable for inclusion in an immunogenic composition of the present disclosure comprises, in order from N-terminus to C-terminus: a) an HCV E2 polypeptide; and I(E/D)GR (SEQ ID NO:125).

E1 with C-Terminal Heterologous Amino Acids

In some cases, an HCV E1/E2 heterodimer suitable for inclusion in an immunogenic composition of the present disclosure comprises a modified HCV E1 polypeptide with from 1 to 6 amino acids from a proteolytically cleavable linker on the C-terminus of the E1 polypeptide. In some cases, an HCV E1/E2 heterodimer suitable for inclusion in an immunogenic composition of the present disclosure comprises: a) an HCV E2 polypeptide; and b) a modified E1 polypeptide comprising, in order from N-terminus to C-terminus: i) an HCV E1 polypeptide; and ii) from 1 to 6 heterologous amino acids wherein the from 1 to 6 heterologous amino acids are N-terminal to a site of proteolytic cleavage in a proteolytically cleavable linker.

Proteolytically cleavable linkers are described elsewhere herein. Following proteolytic cleavage of a precursor polypeptide (e.g., a precursor polypeptide comprising, in order from N-terminus to C-terminus: a) HCV E1 polypeptide; b) a proteolytically cleavable linker; and c) an Fc polypeptide or an HCV E2 polypeptide), a modified E1 polypeptide is generated, which modified E1 polypeptide comprises, at its C-terminus, amino acids N-terminal to the protease cleavage site within the proteolytically cleavable linker.

For example, where the proteolytically cleavable linker comprises a PreScission cleavage site (LEVLFQGP; SEQ ID NO:117), where cleavage occurs between the glutamine and the glycine, a modified E1 polypeptide present in an HCV E1/E2 heterodimer suitable for inclusion in an immunogenic composition of the present disclosure comprises, in order from N-terminus to C-terminus: a) an HCV E1 polypeptide; and b) LEVLFQ (SEQ ID NO:122).

As another example, where the proteolytically cleavable linker comprises an enterokinase cleavage site (DDDDK; SEQ ID NO:123), where cleavage occurs C-terminal to the Lys, a modified E1 polypeptide present in an HCV E1/E2 heterodimer suitable for inclusion in an immunogenic composition of the present disclosure comprises, in order from N-terminus to C-terminus: a) an HCV E1 polypeptide; and b) DDDDK (SEQ ID NO:123).

As another example, where the proteolytically cleavable linker comprises a TEV cleavage site (ENLYFQG; SEQ ID NO:119), where cleavage occurs between the glutamine and the glycine, a modified E1 polypeptide present in an HCV E1/E2 heterodimer suitable for inclusion in an immunogenic composition of the present disclosure comprises, in order from N-terminus to C-terminus: a) an HCV E1 polypeptide; and b) ENLYFQ (SEQ ID NO:151).

As another example, where the proteolytically cleavable linker comprises a thrombin cleavage site (LVPRGS; SEQ ID NO:120), where cleavage occurs between the arginine and the glycine, a modified E1 polypeptide present in an HCV E1/E2 heterodimer suitable for inclusion in an immunogenic composition of the present disclosure comprises, in order from N-terminus to C-terminus: a) an HCV E1 polypeptide; and LVPR (SEQ ID NO:124).

As another example, where the proteolytically cleavable linker comprises a Factor Xa cleavage site (I(E/D)GRX, where X is any amino acid except arginine or proline; SEQ ID NO:121), where cleavage occurs between the arginine and the X, a modified E1 polypeptide present in an HCV E1/E2 heterodimer suitable for inclusion in an immunogenic composition of the present disclosure comprises, in order from N-terminus to C-terminus: a) an HCV E1 polypeptide; and I(E/D)GR (SEQ ID NO:125).

Additional Polypeptides

In any of the above-described embodiments, one or both of the polypeptide chains of the E1/E2 heterodimer can include one or more additional polypeptides. For example, the E1 polypeptide, the E2 polypeptide, or both the E1 and the E2 polypeptide, can include an affinity tag. Suitable affinity tags include, e.g., immunoglobulin Fc polypeptides, a poly(histidine) tag (e.g., His6), a maltose binding protein (MBP), a glutathione-S-transferase (GST) polypeptide, calmodulin-binding peptide (CBP), Streptavidin-binding peptide (SBP), Strep-tag II, FLAG (e.g., DYKDDDDK (SEQ ID NO:126), hemagglutinin (HA) (e.g., YPYDVPDYA (SEQ ID NO:127), c-myc T7 ((e.g., EQKLISEEDL; SEQ ID NO:128), Glu-Glu, starch-binding domain (SBD), and Flag-Acidic-Target Tag (FATT), and the like.

In some cases, an E1/E2 heterodimer included in a composition of the present disclosure includes a variant E2 polypeptide. In some cases, the E1 polypeptide or the variant E2 polypeptide can include an Ig Fc polypeptide at the C-terminus of the E1 polypeptide or the variant E2 polypeptide. As another example, in some cases, the E1 polypeptide or the variant E2 polypeptide can include an Ig Fc polypeptide at the N-terminus of the E1 polypeptide or the variant E2 polypeptide. Ig Fc polypeptides are known in the art, and are described elsewhere herein.

T-Cell Epitope Polypeptides

In some cases, one or both of the polypeptide chains of the E1/E2 heterodimer present in an immunogenic composition of the present disclosure can include a T-cell epitope polypeptide. In some cases, an E2 polypeptide present in an E1/E2 heterodimer present in an immunogenic composition of the present disclosure includes a T-cell epitope polypeptide. In some cases, an E1 polypeptide present in an E1/E2 heterodimer present in an immunogenic composition of the present disclosure includes a T-cell epitope polypeptide. In some cases, an HCV E2 polypeptide present in an immunogenic composition of the present disclosure includes a T-cell epitope polypeptide. In some cases, an HCV E1 polypeptide present in an immunogenic composition of the present disclosure includes a T-cell epitope polypeptide. In these embodiments, the T-cell epitope is covalently linked to the E1 and/or E2 polypeptide. For example, in some cases, the T-cell epitope is covalently linked to the amino terminus (N-terminus) of the HCV E1 polypeptide. In some cases, the T-cell epitope is covalently linked to the carboxyl terminus (C-terminus) of the HCV E1 polypeptide. Thus, e.g., in some cases, an immunogenic composition of the present disclosure comprises: a) a fusion polypeptide comprising, in order from N-terminus to C-terminus: i) an HCV E1 polypeptide; and ii) a T-cell epitope polypeptide; and b) a CDN. In some cases, an immunogenic composition of the present disclosure comprises: a) a fusion polypeptide comprising, in order from N-terminus to C-terminus: i) an HCV E2 polypeptide; and ii) a T-cell epitope polypeptide; and b) a CDN. In some cases, an immunogenic composition of the present disclosure comprises: a) a fusion polypeptide comprising, in order from N-terminus to C-terminus: i) a T-cell epitope polypeptide; and ii) an HCV E1 polypeptide; and b) a CDN. In some cases, an immunogenic composition of the present disclosure comprises: a) a fusion polypeptide comprising, in order from N-terminus to C-terminus: i) a T-cell epitope polypeptide; and ii) an HCV E2 polypeptide; and b) a CDN. In some cases, an immunogenic composition of the present disclosure comprises: a) an HCV E1E2 heterodimer comprising i) a fusion polypeptide comprising, in order from N-terminus to C-terminus: an HCV E1 polypeptide; and a T-cell epitope polypeptide; and ii) an HCV E2 polypeptide; and b) a CDN. In some cases, an immunogenic composition of the present disclosure comprises: a) an HCV E1E2 heterodimer comprising i) a fusion polypeptide comprising, in order from N-terminus to C-terminus: an HCV E2 polypeptide; and a T-cell epitope polypeptide; and ii) an HCV E2 polypeptide; and b) a CDN. In some cases, an immunogenic composition of the present disclosure comprises: a) an HCV E1E2 heterodimer comprising i) a fusion polypeptide comprising, in order from N-terminus to C-terminus: a T-cell epitope polypeptide; and an HCV E1 polypeptide; and ii) an HCV E2 polypeptide; and b) a CDN. In some cases, an immunogenic composition of the present disclosure comprises: a) an HCV E1E2 heterodimer comprising i) a fusion polypeptide comprising, in order from N-terminus to C-terminus: a T-cell epitope polypeptide; and an HCV E2 polypeptide; and ii) an HCV E1 polypeptide; and b) a CDN.

In some cases, an immunogenic composition of the present disclosure comprises a T-cell epitope polypeptide, where the T-cell epitope polypeptide is not covalently linked to the HCV E1/E2 heterodimer, the HCV E1 polypeptide or the HCV E2 polypeptide. For example, in some cases, an immunogenic composition of the present disclosure comprises: a) an HCV E1/E2 heterodimer; b) a CDN; and c) a T-cell epitope polypeptide. In some cases, an immunogenic composition of the present disclosure comprises: a) an HCV E2 polypeptide; b) a CDN; and c) a T-cell epitope polypeptide. In some cases, an immunogenic composition of the present disclosure comprises: a) an HCV E1 polypeptide; b) a CDN; and c) a T-cell epitope polypeptide.

A T-cell epitope polypeptide suitable for inclusion in an immunogenic composition of the present disclosure comprises a T-cell epitope present in an HCV protein other than E1 and E2. T-cell epitope polypeptides suitable for inclusion in an immunogenic composition of the present disclosure comprise T cell epitopes that are conserved among different HCV genotypes leading to cross-reactive cellular immune responses. In some cases, the T-cell epitope polypeptide does not include a neotope; for example, in some cases, the T-cell epitope polypeptide does not include a junction formed by amino acid sequences that do not naturally occur adjacent to one another in a naturally-occurring HCV polypeptide.

In some cases, the T-cell epitope polypeptide comprises 1, 2, 3, 4, 5, 6, 7, 8, 9, or 10, or more than 10 (e.g., from 10 to 15, from 15 to 20, from 20 to 25, or from 25 to 30, or more than 30), T cell epitopes. T-cell epitopes are epitopes that, when presented with a major histocompatibility complex (MHC) (e.g., a human leukocyte antigen (HLA)) Class I or MHC Class II molecule, are recognized and bound by a T-cell receptor (TCR) present on a T cell surface. T-cell epitopes include epitopes recognized by cytotoxic T cells (e.g., $CD8^+$ T cells), and epitopes recognized by helper T cells (e.g., $CD4^+$ T cells).

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the T-cell epitope polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. A suitable source of T-cell epitopes includes non-toxic mutants of toxins, where the mutants are referred to as "cross-reactive material (CRM)." Other examples of strong T helper epitopes are diphtheria toxoid, tetanus toxoid, meningococcal outer membrane protein, or mutant diphtheria protein CRM197 (see, e.g.: worldwide-website: medscape.com/viewarticle/431127).

In some cases, the T-cell epitope polypeptide comprises a single T-cell epitope. In some cases, the heterologous polypeptide comprises a single HCV-NS3 T-cell epitope. In some cases, the T-cell epitope polypeptide comprises 2 or more T-cell epitopes. In some cases, the T-cell epitope polypeptide comprises 2 or more HCV-NS3 T-cell epitopes. In some cases, the T-cell epitope polypeptide comprises 3 or more HCV-NS3 T-cell epitopes. In some cases, the T-cell epitope polypeptide comprises 4 or more HCV-NS3 T-cell epitopes. In some cases, the T-cell epitope polypeptide comprises a single HCV-NS3 $CD4^+$ T-cell epitope. In some cases, the T-cell epitope polypeptide comprises 2 or more HCV-NS3 $CD4^+$ T-cell epitopes. In some cases, the T-cell epitope polypeptide comprises one or more HCV $CD8^+$ T cell epitopes. In some cases, the T-cell epitope polypeptide comprises a single HCV-NS3 $CD8^+$ T-cell epitope. In some cases, the T-cell epitope polypeptide comprises 2 or more HCV-NS3 $CD8^+$ T-cell epitopes. In some cases, the T-cell epitope polypeptide comprises at least one HCV $CD4^+$ T cell epitope and at least one HCV $CD8^+$ T cell epitope. In some cases, the T-cell epitope polypeptide comprises at least one HCV-NS3 $CD4^+$ T cell epitope and at least one HCV-NS3 $CD8^+$ T cell epitope. In some cases, T-cell epitope polypeptide comprises 2 or more HCV-NS3 $CD4^+$ T-cell epitopes and 2 or more HCV-NS3 $CD8^+$ T-cell epitopes. In some cases, the T-cell epitope polypeptide comprises 2, 3, 4, or 5 HCV-NS3 $CD4^+$ T-cell epitopes and 2, 3, 4, or 5 HCV-NS3 $CD8^+$ T-cell epitopes.

In some cases, the T-cell epitope polypeptide comprises a single T-cell epitope. In some cases, the T-cell epitope polypeptide comprises a single HCV-NS2 T-cell epitope. In some cases, the T-cell epitope polypeptide comprises 2 or more T-cell epitopes. In some cases, the T-cell epitope polypeptide comprises 2 or more HCV-NS2 T-cell epitopes. In some cases, the T-cell epitope polypeptide comprises 3 or more HCV-NS2 T-cell epitopes. In some cases, the T-cell epitope polypeptide comprises 4 or more HCV-NS2 T-cell epitopes. In some cases, the T-cell epitope polypeptide comprises a single HCV-NS2 $CD4^+$ T-cell epitope. In some cases, the T-cell epitope polypeptide comprises 2 or more HCV-NS2 $CD4^+$ T-cell epitopes. In some cases, the T-cell epitope polypeptide comprises one or more HCV $CD8^+$ T cell epitopes. In some cases, the T-cell epitope polypeptide comprises a single HCV-NS2 $CD8^+$ T-cell epitope. In some cases, the T-cell epitope polypeptide comprises 2 or more HCV-NS2 $CD8^+$ T-cell epitopes. In some cases, the T-cell epitope polypeptide comprises at least one HCV $CD4^+$ T cell epitope and at least one HCV $CD8^+$ T cell epitope. In some cases, the T-cell epitope polypeptide comprises at least one HCV-NS2 $CD4^+$ T cell epitope and at least one HCV-NS2 $CD8^+$ T cell epitope. In some cases, T-cell epitope polypeptide comprises 2 or more HCV-NS2 $CD4^+$ T-cell epitopes and 2 or more HCV-NS2 $CD8^+$ T-cell epitopes. In some cases, the T-cell epitope polypeptide comprises 2, 3, 4, or 5 HCV-NS2 $CD4^+$ T-cell epitopes and 2, 3, 4, or 5 HCV-NS2 $CD8^+$ T-cell epitopes.

In some cases, the T cell epitope polypeptide comprises a single T-cell epitope. In some cases, the T cell epitope polypeptide comprises a single HCV-NS4A T-cell epitope. In some cases, the T cell epitope polypeptide comprises 2 or more T-cell epitopes. In some cases, the T cell epitope polypeptide comprises 2 or more HCV-NS4A T-cell epitopes. In some cases, the T cell epitope polypeptide comprises 3 or more HCV-NS4A T-cell epitopes. In some cases, the T cell epitope polypeptide comprises 4 or more HCV-NS4A T-cell epitopes. In some cases, the T cell epitope polypeptide comprises a single HCV-NS4A $CD4^+$ T-cell epitope. In some cases, the T cell epitope polypeptide comprises 2 or more HCV-NS4A $CD4^+$ T-cell epitopes. In some cases, the T cell epitope polypeptide comprises one or more HCV CD8⁺ T cell epitopes. In some cases, the T cell epitope polypeptide comprises a single HCV-NS4A CD8⁺ T-cell epitope. In some cases, the T cell epitope polypeptide comprises 2 or more HCV-NS4A CD8⁺ T-cell epitopes. In some cases, the T cell epitope polypeptide comprises at least one HCV CD4⁺ T cell epitope and at least one HCV CD8⁺ T cell epitope. In some cases, the T cell epitope polypeptide comprises at least one HCV-NS4A CD4⁺ T cell epitope and at least one HCV-NS4A CD8⁺ T cell epitope. In some cases, T cell epitope polypeptide comprises 2 or more HCV-NS4A CD4⁺ T-cell epitopes and 2 or more HCV-NS4A CD8⁺ T-cell epitopes. In some cases, the T cell epitope polypeptide comprises 2, 3, 4, or 5 HCV-NS4A CD4⁺ T-cell epitopes and 2, 3, 4, or 5 HCV-NS4A CD8⁺ T-cell epitopes.

In some cases, the T cell epitope polypeptide comprises a single T-cell epitope. In some cases, the T cell epitope polypeptide comprises a single HCV-NS5A T-cell epitope. In some cases, the T cell epitope polypeptide comprises 2 or more T-cell epitopes. In some cases, the T cell epitope polypeptide comprises 2 or more HCV-NS5A T-cell epitopes. In some cases, the T cell epitope polypeptide comprises 3 or more HCV-NS5A T-cell epitopes. In some cases, the T cell epitope polypeptide comprises 4 or more HCV-NS5A T-cell epitopes. In some cases, the T cell epitope polypeptide comprises a single HCV-NS5A CD4⁺ T-cell epitope. In some cases, the T cell epitope polypeptide comprises 2 or more HCV-NS5A CD4⁺ T-cell epitopes. In some cases, the T cell epitope polypeptide comprises one or more HCV CD8⁺ T cell epitopes. In some cases, the T cell epitope polypeptide comprises a single HCV-NS5A CD8⁺ T-cell epitope. In some cases, the T cell epitope polypeptide comprises 2 or more HCV-NS5A CD8⁺ T-cell epitopes. In some cases, the T cell epitope polypeptide comprises at least one HCV CD4⁺ T cell epitope and at least one HCV CD8⁺ T cell epitope. In some cases, the T cell epitope polypeptide comprises at least one HCV-NS5A CD4⁺ T cell epitope and at least one HCV-NS5A CD8⁺ T cell epitope. In some cases, T cell epitope polypeptide comprises 2 or more HCV-NS5A CD4⁺ T-cell epitopes and 2 or more HCV-NS5A CD8⁺ T-cell epitopes. In some cases, the T cell epitope polypeptide comprises 2, 3, 4, or 5 HCV-NS5A CD4⁺ T-cell epitopes and 2, 3, 4, or 5 HCV-NS5A CD8⁺ T-cell epitopes.

In some cases, the T cell epitope polypeptide comprises a single T-cell epitope. In some cases, the T cell epitope polypeptide comprises a single HCV-NS5B T-cell epitope. In some cases, the T cell epitope polypeptide comprises 2 or more T-cell epitopes. In some cases, the T cell epitope polypeptide comprises 2 or more HCV-NS5B T-cell epitopes. In some cases, the T cell epitope polypeptide comprises 3 or more HCV-NS5B T-cell epitopes. In some cases, the T cell epitope polypeptide comprises 4 or more HCV-NS5B T-cell epitopes. In some cases, the T cell epitope polypeptide comprises a single HCV-NS5B CD4⁺ T-cell epitope. In some cases, the T cell epitope polypeptide comprises 2 or more HCV-NS5B CD4⁺ T-cell epitopes. In some cases, the T cell epitope polypeptide comprises one or more HCV CD8⁺ T cell epitopes. In some cases, the T cell epitope polypeptide comprises a single HCV-NS5B CD8⁺ T-cell epitope. In some cases, the T cell epitope polypeptide comprises 2 or more HCV-NS5B CD8⁺ T-cell epitopes. In some cases, the T cell epitope polypeptide comprises at least one HCV CD4⁺ T cell epitope and at least one HCV CD8⁺ T cell epitope. In some cases, the T cell epitope polypeptide comprises at least one HCV-NS5B CD4⁺ T cell epitope and at least one HCV-NS5B CD8⁺ T cell epitope. In some cases, T cell epitope polypeptide comprises 2 or more HCV-NS5B CD4⁺ T-cell epitopes and 2 or more HCV-NS5B CD8⁺ T-cell epitopes. In some cases, the T cell epitope polypeptide comprises 2, 3, 4, or 5 HCV-NS5B CD4⁺ T-cell epitopes and 2, 3, 4, or 5 HCV-NS5B CD8⁺ T-cell epitopes.

In some cases, the T cell epitope polypeptide comprises a single T-cell epitope. In some cases, the T cell epitope polypeptide comprises a single HCV-core T-cell epitope. In some cases, the T cell epitope polypeptide comprises 2 or more T-cell epitopes. In some cases, the T cell epitope polypeptide comprises 2 or more HCV-core T-cell epitopes. In some cases, the T cell epitope polypeptide comprises 3 or more HCV-core T-cell epitopes. In some cases, the T cell epitope polypeptide comprises 4 or more HCV-core T-cell epitopes. In some cases, the T cell epitope polypeptide comprises a single HCV-core CD4⁺ T-cell epitope. In some cases, the T cell epitope polypeptide comprises 2 or more HCV-core CD4⁺ T-cell epitopes. In some cases, the T cell epitope polypeptide comprises one or more HCV CD8⁺ T cell epitopes. In some cases, the T cell epitope polypeptide comprises a single HCV-core CD8⁺ T-cell epitope. In some cases, the T cell epitope polypeptide comprises 2 or more HCV-core CD8⁺ T-cell epitopes. In some cases, the T cell epitope polypeptide comprises at least one HCV CD4⁺ T cell epitope and at least one HCV CD8⁺ T cell epitope. In some cases, the T cell epitope polypeptide comprises at least one HCV-core CD4⁺ T cell epitope and at least one HCV-core CD8⁺ T cell epitope. In some cases, T cell epitope polypeptide comprises 2 or more HCV-core CD4⁺ T-cell epitopes and 2 or more HCV-core CD8⁺ T-cell epitopes. In some cases, the T cell epitope polypeptide comprises 2, 3, 4, or 5 HCV-core CD4⁺ T-cell epitopes and 2, 3, 4, or 5 HCV-core CD8⁺ T-cell epitopes.

In some cases, the T cell epitope polypeptide comprises a single T-cell epitope. In some cases, the T cell epitope polypeptide comprises a single HCV-p7 T-cell epitope. In some cases, the T cell epitope polypeptide comprises 2 or more T-cell epitopes. In some cases, the T cell epitope polypeptide comprises 2 or more HCV-p7 T-cell epitopes. In some cases, the T cell epitope polypeptide comprises 3 or more HCV-p7 T-cell epitopes. In some cases, the T cell epitope polypeptide comprises 4 or more HCV-p7 T-cell epitopes. In some cases, the T cell epitope polypeptide comprises a single HCV-p7 CD4⁺ T-cell epitope. In some cases, the T cell epitope polypeptide comprises 2 or more HCV-core CD4⁺ T-cell epitopes. In some cases, the T cell epitope polypeptide comprises one or more HCV CD8⁺ T cell epitopes. In some cases, the T cell epitope polypeptide comprises a single HCV-p7 CD8⁺ T-cell epitope. In some cases, the T cell epitope polypeptide comprises 2 or more HCV-p7 CD8⁺ T-cell epitopes. In some cases, the T cell epitope polypeptide comprises at least one HCV CD4⁺ T cell epitope and at least one HCV CD8⁺ T cell epitope. In some cases, the T cell epitope polypeptide comprises at least one HCV-p7 CD4⁺ T cell epitope and at least one HCV-p7 CD8⁺ T cell epitope. In some cases, T cell epitope polypeptide comprises 2 or more HCV-p7 CD4⁺ T-cell epitopes and 2 or more HCV-p7 CD8⁺ T-cell epitopes. In some cases, the T-cell epitope polypeptide comprises 2, 3, 4, or 5 HCV-p7 CD4⁺ T-cell epitopes and 2, 3, 4, or 5 HCV-p7 CD8⁺ T-cell epitopes.

In some cases, the T cell epitope polypeptide comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, or 63, of the T-cell epitopes set out in FIG. 9A-9B. In some cases, the T cell epitope polypeptide comprises from 1 to 3, from 3 to 5, from 5 to 10, from 10 to 15, from 15 to 20, from 20 to 25, or from 25 to 30 of the T-cell epitopes set out in FIG. 9A-9B. For example, in some cases, the T cell epitope polypeptide comprises the T-cell epitopes designated NS3-3, NS3-4, and NS3-11 in FIG. 9A-9B and FIG. 11A-11N. As another example, in some cases, the T cell epitope polypeptide comprises the T-cell epitopes designated NS2-1, NS2-2, NS2-3, NS2-7, and NS2-8 in FIG. 9A-9B and FIG. 11A-11N. As another example, in some cases, the T cell epitope polypeptide comprises the T-cell epitopes designated NS3-3, NS3-4, NS3-5, and NS3-11 in FIG. 9A-9B and FIG. 11A-11N. As another example, in some cases, the T cell epitope polypeptide comprises the T-cell epitopes designated NS3-3, NS3-4, NS3-5, NS3-6, NS3-7, NS3-11, NS3-12, and NS3-13 in FIG. 9A-9B and FIG. 11A-11N. As another example, in some cases, the T cell epitope polypeptide comprises the T-cell epitopes designated NS3-3, NS3-4, NS3-5, NS3-6, NS3-7, NS3-10, NS3-11, NS3-12, and NS3-13 in FIG. 9A-9B and FIG. 11A-11N. As another example, in some cases, the T cell epitope polypeptide comprises the T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, and Core-22 in FIG. 9A-9B and FIG. 11A-11N. As another example, in some cases, the T cell epitope polypeptide comprises the T-cell epitopes designated NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. As another example, in some cases, the T cell epitope polypeptide comprises the T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. As another example, in some cases, the T cell epitope polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, and NS4b-10 in FIG. 9A-9B and FIG. 11A-11N. As another example, in some cases, the T cell epitope polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, and NS5b-2 in FIG. 9A-9B and FIG. 11A-11N. In some cases, the T-cell epitopes are contiguous. In some cases, any two T-cell epitopes are separated by linkers (e.g., a linker having a length of from 1 amino acid to about 50 amino acids, e.g., from 1 amino acid to 5 amino acids (aa), from 5 aa to 10 aa, from 10 aa to 15 aa, from 15 aa to 20 aa, from 20 aa to 25 aa, from 25 aa to 30 aa, from 30 aa to 40 aa, or from 40 aa to 50 aa).

In some cases, the T cell epitope polypeptide comprises at least one HCV CD4$^+$ T cell epitope and at least one HCV CD8$^+$ T cell epitope, where epitopes are conserved among HCV genotypes 1 and 2. In some cases, the T cell epitope polypeptide comprises at least one HCV CD4$^+$ T cell epitope and at least one HCV CD8$^+$ T cell epitope, where epitopes are conserved among HCV genotypes 1 and 3. In some cases, the T cell epitope polypeptide comprises at least one HCV CD4$^+$ T cell epitope and at least one HCV CD8$^+$ T cell epitope, where epitopes are conserved among HCV genotypes 1, 2, and 3. In some cases, the T cell epitope polypeptide comprises at least one HCV CD4$^+$ T cell epitope and at least one HCV CD8$^+$ T cell epitope, where epitopes are conserved among HCV genotypes 1, 2, 3, and 7. In some cases, the T cell epitope polypeptide comprises at least one HCV CD4$^+$ T cell epitope and at least one HCV CD8$^+$ T cell epitope, where epitopes are conserved among HCV genotypes 1-7.

The T cell epitope polypeptide can have a length of from about 10 amino acids to about 2000 amino acids; e.g., the T cell epitope polypeptide can have a length of from 10 amino acids (aa) to 15 aa, from 15 aa to 20 aa, from 20 aa to 25 aa, from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The T-cell epitope polypeptide can have a length of from about 25 amino acids to about 2000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, or from 1900 aa to 2000 aa. The T-cell epitope polypeptide can have a length of from about 25 amino acids to about 3000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, from 1900 aa to 2000 aa, from 2000 aa to 2250 aa, from 2250 aa to 2500 aa, from 2500 aa to 2750 aa, or from 2750 aa to 3000 aa.

The T cell epitope polypeptide can have a length of from about 25 amino acids to about 800 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The T-cell epitope polypeptide can have a length of from about 25 amino acids to about 400 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, or from 350 aa to 400 aa. The T-cell epitope polypeptide can have a length of 25 amino acids (aa), 26 aa, 27 aa, 28 aa, 29 aa, 30 aa, 31 aa, 32 aa, 33 aa, 34 aa, 35 aa, 36 aa, 37 aa, 38 aa, 39 aa, 40 aa, 41 aa, 42 aa, 43 aa, 44 aa, 45 aa, 46 aa, 47 aa, 48 aa, 49 aa, or 50 aa. The T cell epitope polypeptide can have a length of from about 100 amino acids (aa) to 800 aa, e.g., from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The T cell epitope polypeptide can have a length of from 25 aa to 30 aa. The T cell epitope polypeptide can have a length of from 30 aa to 40 aa. The T cell epitope polypeptide can have a length of from 40 aa to 50 aa. The T-cell epitope polypeptide can have a length of from 50 aa to 60 aa (e.g., 50 aa, 51 aa, 52, aa, 53 aa, 54 aa, 55 aa, 56 aa, 57 aa, 58 aa, 59 aa, or 60 aa). The T cell epitope polypeptide can have a length of from 60 aa to 70 aa. The T cell epitope polypeptide can have a length of from 65 aa to 75 aa (e.g., 65, 66, 67, 68, 69, 70, 71, 72, 7, 74, or 75 aa). The T cell epitope polypeptide can have a length of 70 aa. The T cell epitope polypeptide can have a length of from 70 aa to 80 aa. The T cell epitope polypeptide can have a length of from 80 aa to 90 aa. The T cell epitope polypeptide can have a length of from 90 aa to 100 aa. The T cell epitope polypeptide can have a length of from 100 aa to 105 aa (e.g., 100, 101, 102, 103, 104, 105, 106, 107, 108, 109, or 110 aa). The T cell epitope polypeptide can have a length of 100 aa. The T cell epitope polypeptide can have a length of from 10 amino acids (aa) to 50 aa; e.g., from 10 aa to 15 aa, from 15 aa to 20 aa, from 20 aa to 25 aa, from 25 aa to 30 aa, from 30 aa to 35 aa, from 35 aa to 40 aa, from 40 aa to 45 aa, or from 45 aa to 50 aa. The T cell epitope polypeptide can have a length of from 10 amino acids (aa) to 20 aa, e.g., 10, 11, 12, 13, 14, 15, 16, 17, 18, 19, or 20 aa.

HCV NS3 T-Cell Epitopes

In some cases, the T cell epitope polypeptide present in an immunogenic composition of the present disclosure includes one or more T-cell epitopes present in an HCV NS3 polypeptide. Examples of T-cell epitopes present in NS3 polypeptides are depicted in FIG. 11A-11N, FIG. 9B, and FIG. 10A-10B.

The T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKKCDELAAKL (SEQ ID NO:85). AIPLEVIKGGRHLIFCHSKKKKCDELAAKL (SEQ ID NO:85) is referred to in FIG. 10A as "TP29." In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKKCDELAAKL (SEQ ID NO:85); and has a length of from 25 aa to 35 aa (e.g., 25 aa, 26 aa, 27 aa, 28 aa, 29 aa, 30 aa, 31 aa, 32 aa, 33 aa, 34 aa, or 35 aa). In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKKCDELAAKL (SEQ ID NO:85); and has a length of 29 amino acids. Such a polypeptide can include NS3 T-cell epitopes designated NS3-3, NS3-4, and NS3-11 in FIG. 9B and FIG. 11A-11N.

The T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKKCDELAAKLVALGI-NAVAYYRGLDVSVIPTSG (SEQ ID NO:87). AIPLEVIKGGRHLIFCHSKKKKCDELAAKLVALGINAVAYYR-GLDVSVIPTSG (SEQ ID NO:87) is referred to in FIG. 10A as "TP52." In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHS-KKKKCDELAAKLVALGINAVAYYRGLDVSVIPTSG (SEQ ID NO:87); and has a length of from 45 amino acids to 60 amino acids (e.g., 45 aa, 46 aa, 47 aa, 48 aa, 49 aa, 50 aa, 51 aa, 52 aa, 53 aa, 54 aa, 55 aa, 56 aa, 57 aa, 58 aa, 59 aa, or 60 aa). In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHS-KKKKCDELAAKLVALGINAVAYYRGLDVSVIPTSG (SEQ ID NO:87); and has a length of 52 amino acids. Such a polypeptide can include NS3 T-cell epitopes designated NS3-3, NS3-4, NS3-5, and NS3-11 in FIG. 9B and FIG. 11A-11N.

The T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKKCDELAAKLVALGINAVAYYR-GLDVSVIPTSGDVVVVATDALMTG FTGDFDSVIDCN (SEQ ID NO:88); and has a length of from 65 amino acids to 80 amino acids (e.g., 65 aa, 66 aa, 67 aa, 68 aa, 69 aa, 70 aa, 71 aa, 72 aa, 73 aa, 74 aa, 75 aa, 76 aa, 77 aa, 78 aa, 79 aa, or 80 aa). KGGRHLIFCHSKKKKCDELAAKLVALGI-NAVAYYRGLDVSVIPTSGDVVVVATDALMTG FTGDFDSVIDCN (SEQ ID NO:88) is referred to in FIG. 10A as "TP70."

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKKCDELAAKLVALGI-NAVAYYRGLDVSVIPTSGDVVVVATDALMTG FTGDFDSVIDCN (SEQ ID NO:88); and has a length of 70 amino acids. Such a polypeptide can include NS3 T-cell epitopes designated NS3-3, NS3-4, NS3-5, NS3-6, NS3-7, NS3-11, NS3-12, and NS3-13 in FIG. 9B and FIG. 11A-11N.

The T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:89); and has a length of from 95 amino acids (aa) to 105 aa (e.g., 95 aa, 96 aa, 97 aa, 98 aa, 99 aa, 100 aa, 101 aa, 102 aa, 103 aa, 104 aa, or 105 aa). VALSTTGEIPFYGKAIPLE-VIKGGRHLIFCHSKKKCDELAAKLVALGINAVAYYR-GLDVS VIPTSGDVVV-VATDALMTGFTGDFDSVIDCNTCVTQTVDF (SEQ ID NO:89) is referred to in FIG. 10A as "TP100."

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:89); and has a length of 100 amino acids. Such a polypeptide can include NS3 T-cell epitopes designated NS3-3, NS3-4, NS3-5, NS3-6, NS3-7, NS3-10, NS3-11, NS3-12, and NS3-13 in FIG. 9B and FIG. 11A-11N.

The T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:90); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPG (SEQ ID NO:90) is referred to in FIG. 10A as "TP171."

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGS RPSWGPTDPRRRS RNLGKVIDTLTCGFADLMGYIPLVGAPLGGAARAL-AHGVRVLEDGVNYATGNLPG (SEQ ID NO:90); and has a length of 171 amino acids.

The T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPGCSF SIFL-LALLSCLTVPASA (SEQ ID NO:129); and has a length of from 190 amino acids (aa) to 200 aa (e.g., 190 aa, 191 aa, 192 aa, 193 aa, 194 aa, 195 aa, 196 aa, 197 aa, 198 aa, 199 aa, or 200 aa.

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGS RPSWGPTDPRRRS RNLGKVIDTLTCGFADLMGYIPLVGAPLGGAARAL-AHGVRVLEDGVNYATGNLPGCSF SIFL-LALLSCLTVPASA (SEQ ID NO:129); and has a length of 191 amino acids.

The T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGT VLDQAETAGARLVVLA TATPPGSVTVPHPNIEEVAL-STTGEIPFYGKAIPLEVIKGGRHLIFCHSKKKCDE-LAAKLV ALGINAVAYYRGLDVSVIPTSGDVVV-VATDALMTGFTGDFDSVIDCN (SEQ ID NO:91); and has a length of from 215 amino acids (aa) to 235 aa (e.g., 215 aa, 216 aa, 217 11, 218 aa, 219 aa, 220 aa, 221 aa, 222 aa, 223 aa, 224 aa, 225 aa, 226 aa, 227 aa, 228 aa, 229 aa, 230 aa, 231 aa, 232 aa, 233 aa, 234 aa, or 235 aa). LHAP-TGSGKSTKVPAAYAAQGYKVLVLNPSVAATLGF-GAYMSKAHGIDPNIRTGVRTIT TGSPITYSTYGK- FLADGGCSGGAYDIIICDECHSTDATSILGIGT VLDQAETAGARLVVLA TATPPGSVTVPHPNIEEVAL-STTGEIPFYGKAIPLEVIKGGRHLIFCHSKKKCDE-LAAKLV ALGINAVAYYRGLDVSVIPTSGDVVV-VATDALMTGFTGDFDSVIDCN (SEQ ID NO:91) is referred to in FIG. 10A as "TP228."

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGT VLDQAETAGARLVVLA TATPPGSVTVPHPNIEEVAL-STTGEIPFYGKAIPLEVIKGGRHLIFCHSKKKCDE-LAAKLV ALGINAVAYYRGLDVSVIPTSGDVVV-VATDALMTGFTGDFDSVIDCN (SEQ ID NO:91); and has a length of 228 amino acids. Such a polypeptide can include NS3 T-cell epitopes designated NS3-1, NS3-2, NS3-3, NS3-4, NS3-5, NS3-6, NS3-7, NS3-9, NS3-10, NS3-11, NS3-12, and NS3-13 in FIG. 9B and FIG. 11A-11N.

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1265-1279 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1309-1323 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1401-1415 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1402-1412 of the amino acid sequence designated "Consensus" in FIG. 12A-12L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1429-1439 of the amino acid sequence designated "Consensus" in FIG. 12A-12L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1464 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1453-1467 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1577-1591 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1306-1314 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1387-1394 of the amino acid sequence designated "Consensus" in FIG. 12A-12L, or a corresponding HCV NS3 amino acid sequence of any HCV genotype; and the HCV NS3 T-cell epitope can have a length of from 1 amino acids (aa) to 15 amino acids (e.g., 8 aa, 9 aa, 10 aa, 11 aa, 12 aa, 13 aa, 14 aa, or 15 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1405-1413 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1458 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1457-1465 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1610-1618 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

HCV NS2 T-Cell Epitopes

Figure 11A:
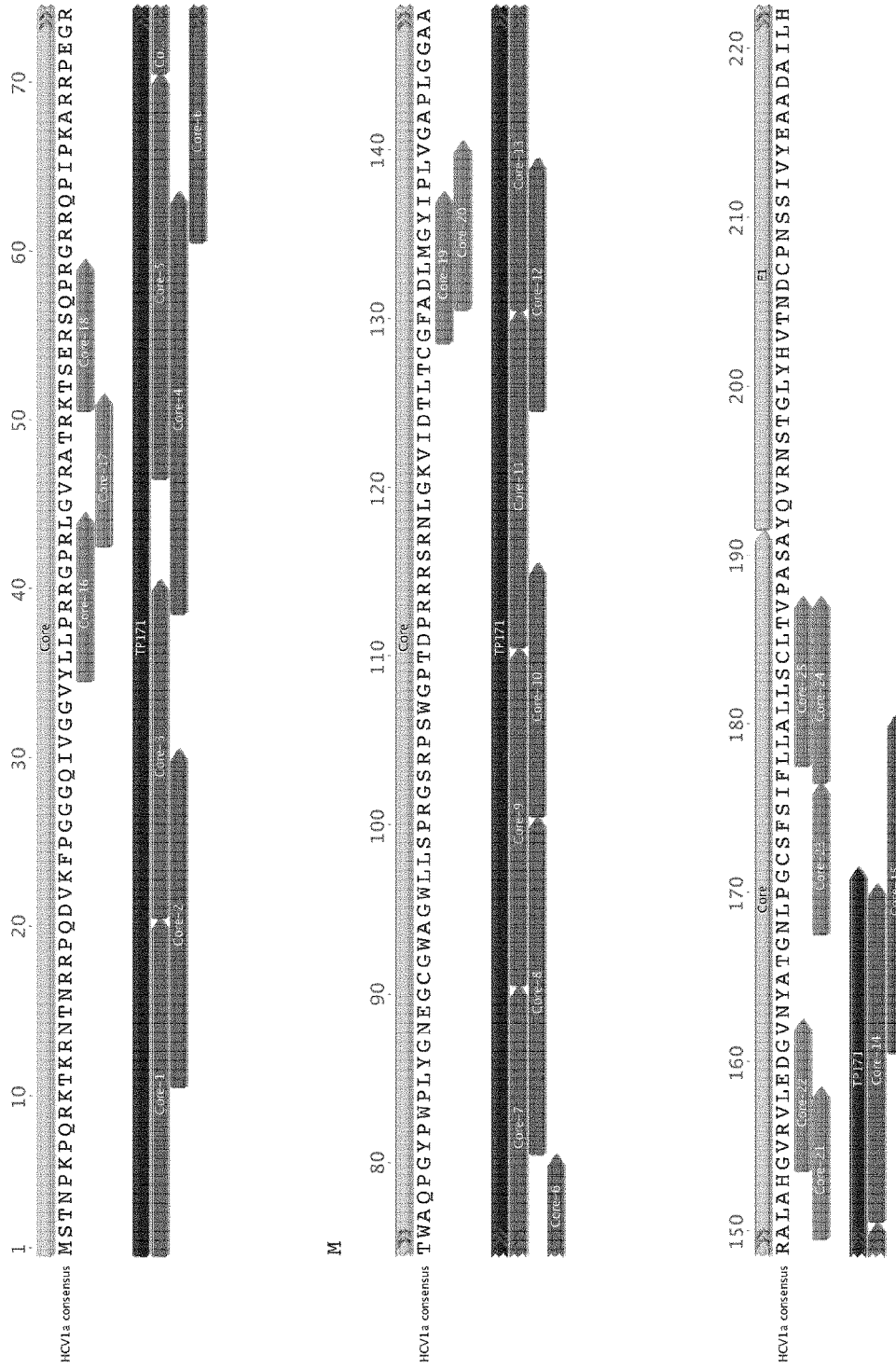
FIG. 11A-11N provide consensus amino acid sequences of HCV polypeptides; and depict the locations of T-cell epitopes (SEQ ID NO:95).
Figure 11B:
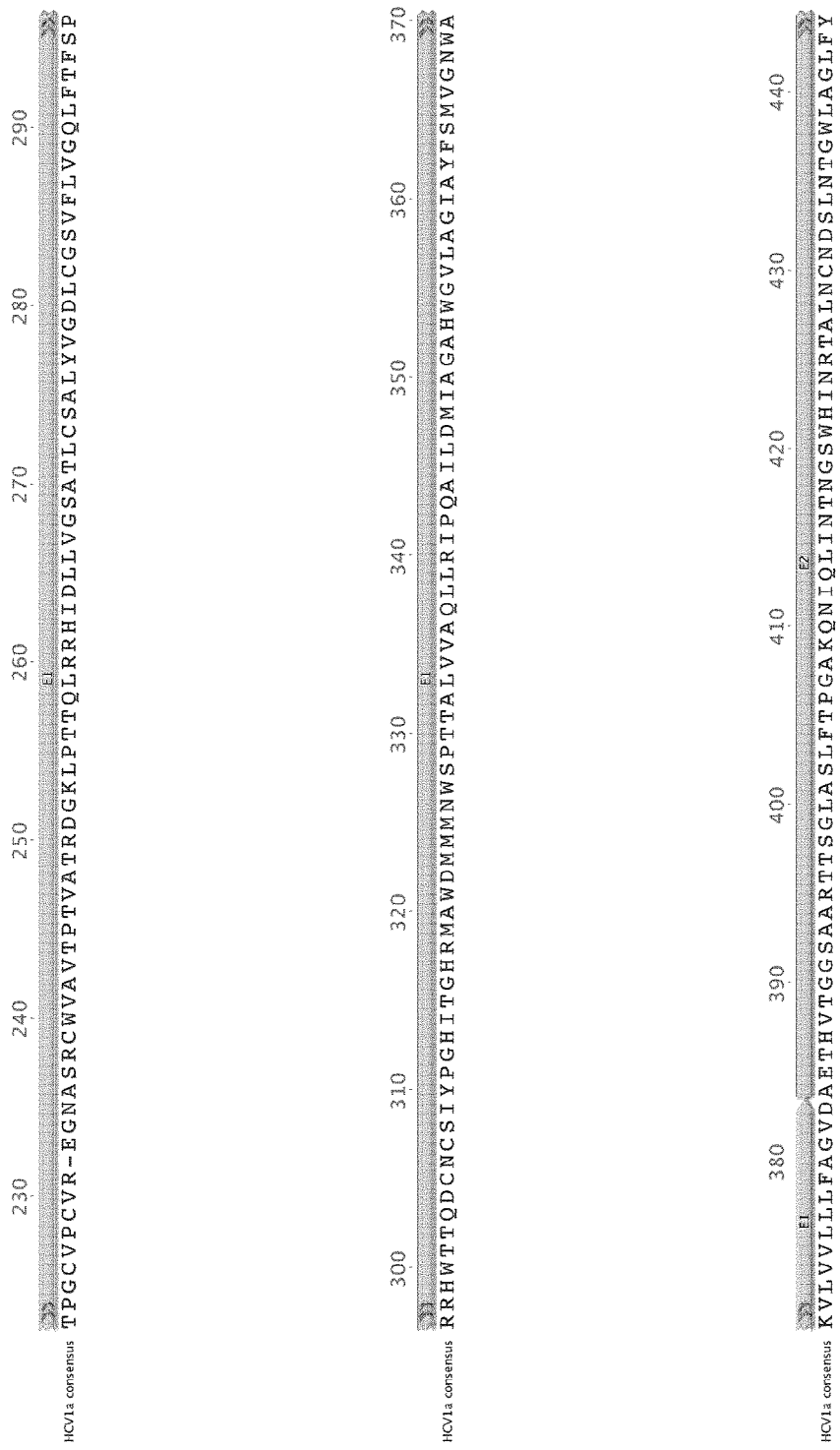
Figure 11D:
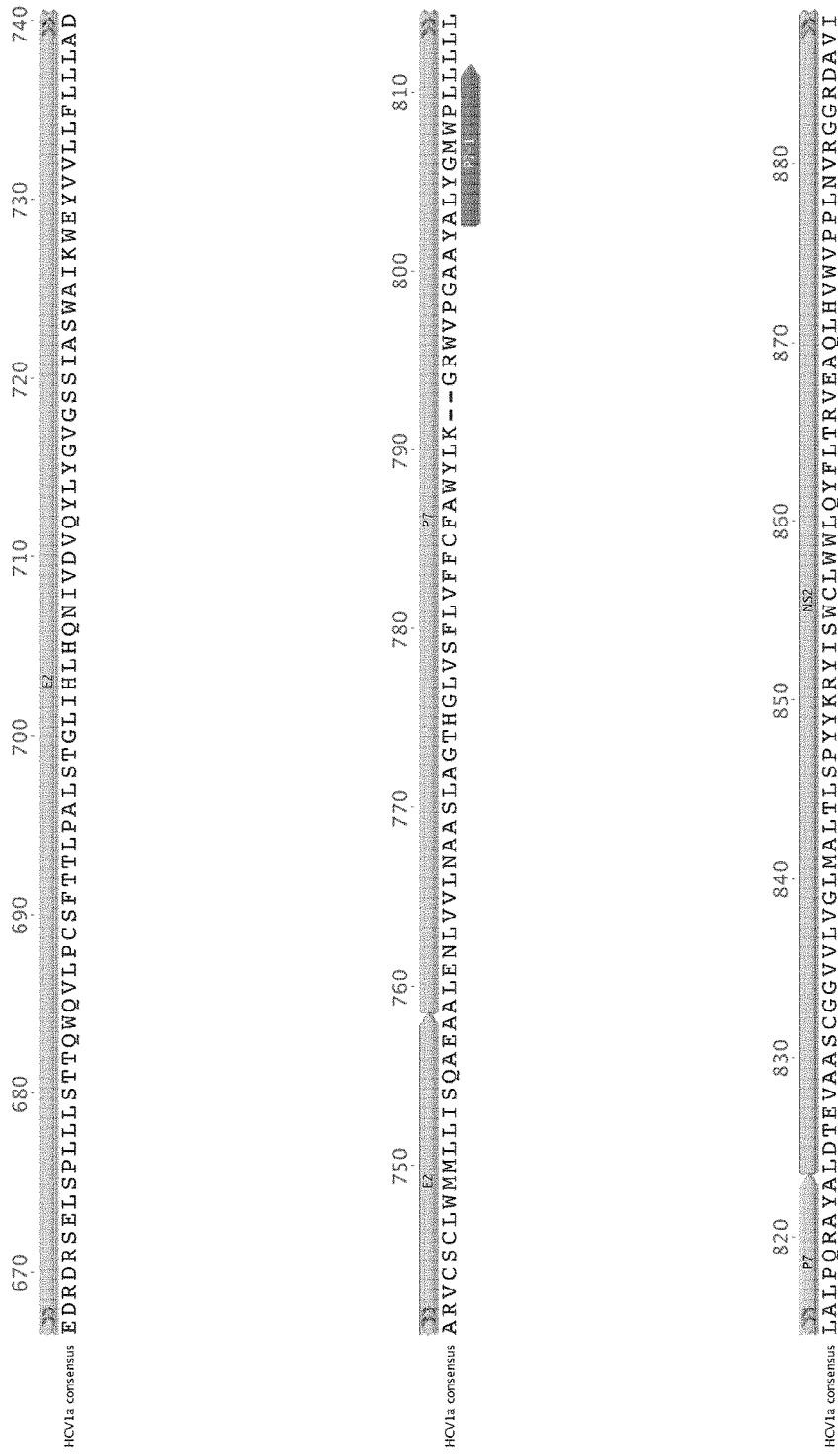

In some cases, the T cell epitope polypeptide present in an immunogenic composition of the present disclosure includes one or more T-cell epitopes present in an HCV NS2 polypeptide. Examples of T-cell epitopes present in NS2 polypeptides are depicted in FIG. 11A-11N, and FIG. 9A.

For example, the T cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-974 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 975-994 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 985-1004 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1015-1034 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1035-1054 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 924-933 of the amino acid sequence designated "Consensus" in FIG. 12A-12L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the T cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 961-970 of the amino acid sequence designated "Consensus" in FIG. 12A-12L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the T cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 989-997 of the amino acid sequence designated "Consensus" in FIG. 12A-12L, or a corresponding HCV NS2 amino acid sequence of any HCV genotype; and the NS2 T cell epitope can have a length of from 9 amino acids (aa) to 15 amino acids (e.g., 9 aa, 10 aa, 11 aa, 12 aa, 13 aa, 14 aa, or 15 aa).

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 50 aa (e.g., from 10 aa to 25 aa, or from 25 aa to 50 aa) of amino acids 955-1004 of the amino acid sequence designated "Consensus" in FIG. 12A-12L, or a corresponding HCV NS2 amino acid sequence of any HCV genotype; and has a length of from 10 amino acids (aa) to 25 aa, or from 25 aa to 50 aa. In some cases, the T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-1004 of the amino acid sequence designated "Consensus" in FIG. 12A-12L, or a corresponding HCV NS2 amino acid sequence of any HCV genotype; and has a length of about 50 amino acids.

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 553 aa (e.g., from 10 aa to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa) of amino acids 917-1469 of the amino acid sequence designated "Consensus" in FIG. 12A-12L, or a corresponding HCV NS2 and NS3 amino acid sequence of any HCV genotype; and has a length of from 10 amino acids (aa) to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa. In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 917-1469 of the amino acid sequence designated "Consensus" in FIG. 12A-12L, or a corresponding HCV NS2 and NS3 amino acid sequence of any HCV genotype; and has a length of about 553 amino acids.

The T cell epitope polypeptide can comprise an amino acid sequence having at least about 20%, at least about 25%, at least about 30%, at least about 35%, at least about 40%, at least about 45%, at least about 50%, at least about 60%, at least about 0%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:86). LGALTGTYVYNHLTPLRDWAHNGLRDLAVAVE-PVVFSQMETKLITWGADT (SEQ ID NO:86) is referred to in FIG. 10A as "TP50." In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:86); and has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa). In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRD-WAHNGLRDLAVAVEPVVFSQMETKLITWGADT (SEQ ID NO:86); and has a length of 50 amino acids. Such a polypeptide can include NS2 T-cell epitopes designated NS2-1, NS2-2, NS2-3, NS2-7, and NS2-8 in FIG. 9A and FIG. 11A-11N.

HCV NS4A T-Cell Epitopes

In some cases, the T cell epitope polypeptide present in an immunogenic composition of the present disclosure includes one or more T-cell epitopes present in an HCV NS4A polypeptide. Examples of T-cell epitopes present in NS4A polypeptides are depicted in FIG. 11A-11N and FIG. 9B.

The T cell epitope polypeptide can comprise an NS4A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1683-1692 of the amino acid sequence designated "Consensus" in FIG. 12A-12L, or a corresponding HCV NS4A amino acid sequence of any HCV genotype; and the NS4A T-cell epitope can have a length of from 10 amino acids (aa) to 15 amino acids (e.g., 10 aa, 11 aa, 12 aa, 13 aa, 14 aa, or 15 aa).

HCV NS4B T-Cell Epitopes

In some cases, the T cell epitope polypeptide present in an immunogenic composition of the present disclosure includes one or more T-cell epitopes present in an HCV NS4B polypeptide. Examples of T-cell epitopes present in NS4B polypeptides are depicted in FIG. 11A-11N and FIG. 9B.

As one example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1790-1801 of the amino acid sequence designated "Consensus" in FIG. 12A-12L, or a corresponding HCV NS4B amino acid sequence of any HCV genotype; and the NS4B T-cell epitope can have a length of from 12 amino acids (aa) to 20 amino acids (e.g., 12 aa, 13 aa, 14 aa, 15 aa, 16 aa, 17 aa, 18 aa, 19 aa, or 20 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1792-1802 of the amino acid sequence designated "Consensus" in FIG. 12A-12L, or a corresponding HCV NS4B amino acid sequence of any HCV genotype; and the NS4B T-cell epitope can have a length of from 11 amino acids (aa) to 20 amino acids (e.g., 11 aa, 12 aa, 13 aa, 14 aa, 15 aa, 16 aa, 17 aa, 18 aa, 19 aa, or 20 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1898-1905 of the amino acid sequence designated "Consensus" in FIG. 12A-12L, or a corresponding HCV NS4B amino acid sequence of any HCV genotype; and the NS4B T-cell epitope can have a length of from 8 amino acids (aa) to 15 amino acids (e.g., 8 aa, 9 aa, 10 aa, 11 aa, 12 aa, 13 aa, 14 aa, or 15 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1921-1935 of the amino acid sequence designated "Consensus" in FIG. 12A-12L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1922-1941 of the amino acid sequence designated "Consensus" in FIG. 12A-12L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1928-1947 of the amino acid sequence designated "Consensus" in FIG. 12A-12L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1868-1876 of the amino acid sequence designated "Consensus" in FIG. 12A-12L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1927-1942 of the amino acid sequence designated "Consensus" in FIG. 12A-12L, or a corresponding HCV NS4B amino acid sequence of any HCV genotype; and the NS4B T-cell epitope can have a length of from 16 amino acids (aa) to 20 amino acids (e.g., 16 aa, 17 aa, 18 aa, 19 aa, or 20 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1932-1940 of the amino acid sequence designated "Consensus" in FIG. 12A-12L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1948-1962 of the amino acid sequence designated "Consensus" in FIG. 12A-12L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

HCV NS5A T-Cell Epitopes

In some cases, the T cell epitope polypeptide present in an immunogenic composition of the present disclosure includes one or more T-cell epitopes present in an HCV NS5A polypeptide. Examples of T-cell epitopes present in NS5A polypeptides are depicted in FIG. 11A-11N and FIG. 9B.

As one example, the T cell epitope polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2218-2232 of the amino acid sequence designated "Consensus" in FIG. 12A-12L, or a corresponding HCV NS5A amino acid sequence of any HCV genotype; and the NS5A T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2309-2317 of the amino acid sequence designated "Consensus" in FIG. 12A-12L, or a corresponding HCV NS5A amino acid sequence of any HCV genotype; and the NS5A T-cell epitope can have a length of from 9 amino acids (aa) to 15 amino acids (e.g., 9 aa, 10 aa, 11 aa, 12 aa, 13 aa, 14 aa, or 15 aa).

HCV NS5B T-Cell Epitopes

In some cases, the T cell epitope polypeptide present in an immunogenic composition of the present disclosure includes one or more T-cell epitopes present in an HCV NS5B polypeptide. Examples of T-cell epitopes present in NS5B polypeptides are depicted in FIG. 11A-11N and FIG. 9B.

As one example, the T cell epitope polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2847-2851 of the amino acid sequence designated "Consensus" in FIG. 12A-12L, or a corresponding HCV NS5B amino acid sequence of any HCV genotype; and the NS5B T-cell epitope can have a length of from 5 amino acids (aa) to 10 amino acids (e.g., 5 aa, 6 aa, 7 aa, 8 aa, 9 aa, or 10 aa).

As another example, the T cell epitope polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2602-2610 of the amino acid sequence designated "Consensus" in FIG. 12A-12L, or a corresponding HCV NS5B amino acid sequence of any HCV genotype; and the NS5B T-cell epitope can have a length of from 9 amino acids (aa) to 15 amino acids (e.g., 9 aa, 10 aa, 11 aa, 12 aa, 13 aa, 14 aa, or 15 aa).

HCV Core T-Cell Epitopes

In some cases, the T cell epitope polypeptide present in an immunogenic composition of the present disclosure includes one or more T-cell epitopes present in an HCV core polypeptide. Examples of T-cell epitopes present in HCV Core polypeptides are depicted in FIG. 11A-11N and FIG. 9A.

As one example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-20 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 11-30 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 21-40 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 39-63 of the amino acid sequence designated "Consensus" in FIG. 12A-12L, or a corresponding HCV core amino acid sequence of any HCV genotype; and the HCV core T-cell epitope can have a length of from 23 amino acids (aa) to 28 amino acids (e.g., 23 aa, 24 aa, 25 aa, 26 aa, 27 aa, or 28 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 47-70 of the amino acid sequence designated "Consensus" in FIG. 12A-12L, or a corresponding HCV core amino acid sequence of any HCV genotype; and the HCV core T-cell epitope can have a length of from 24 amino acids (aa) to 29 amino acids (e.g., 24 aa, 25 aa, 26 aa, 27 aa, 28 aa, or 29 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 61-80 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 71-90 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 81-100 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 91-110 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 101-115 of the amino acid sequence designated "Consensus" in FIG. 12A-12L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 111-130 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 125-139 of the amino acid sequence designated "Consensus" in FIG. 12A-12L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-150 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 151-170 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 161-180 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 35-44 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 43-51 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 51-59 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 129-137 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-140 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 150-158 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 154-162 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 168-176 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 177-187 of the amino acid sequence designated "Consensus" in FIG. 12A-12L, or a corresponding HCV core amino acid sequence of any HCV genotype; and the HCV core T-cell epitope can have a length of from 11 amino acids (aa) to 16 amino acids (e.g., 11 aa, 12 aa, 13 aa, 14 aa, 15 aa, or 16 aa).

As another example, the T cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 178-187 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 191 aa (e.g., from 10 aa to 25 aa, from 25 aa to 50 aa, from 50 aa to 75 aa, from 75 aa to 100 aa, from 100 aa to 150 aa, or from 150 aa to 191 aa) of amino acids 1-191 of the amino acid sequence designated "Consensus" in FIG. 12A-12L, or a corresponding HCV core amino acid sequence of any HCV genotype; and has a length of from 10 amino acids (aa) to 25 aa, from 25 aa to 50 aa, from 50 aa to 100 aa, or from 100 aa to 150 aa, or from 150 aa to 191 aa. In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-191 of the amino acid sequence designated "Consensus" in FIG. 12A-12L, or a corresponding HCV core amino acid sequence of any HCV genotype; and has a length of about 191 amino acids.

The T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:90); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSP RGSRPSWGPTDPRRRS RNLGKVIDTLTCGFADLMGYIPLVGAPLGGAARAL-AHGVRVLEDGVNYATGNLPG (SEQ ID NO:90); and has a length of 171 amino acids. Such a polypeptide can include core T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 in FIG. 9A and FIG. 11A-11N.

HCV p7 T-Cell Epitopes

In some cases, the T cell epitope polypeptide present in an immunogenic composition of the present disclosure includes one or more T-cell epitopes present in an HCV p7 polypeptide. Examples of T-cell epitopes present in HCV p7 polypeptides are depicted in FIG. 11A-11N or FIG. 9A.

As another example, the T cell epitope polypeptide can comprise an HCV p7 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 803-811 of the amino acid sequence designated "Consensus" in FIG. 12A-12L, or a corresponding HCV p7 amino acid sequence of any HCV genotype; and the HCV p7 T-cell epitope can have a length of from 9 amino acids (aa) to 15 amino acids (e.g., 9 aa, 10 aa, 11 aa, 12 aa, 13 aa, 14 aa, or 15 aa).

T-Cell Epitope Polypeptides Including HCV T-Cell Epitopes from More than One HCV Polypeptide Other than E1 and E2

As noted above, a T-cell epitope polypeptide can include T-cell epitopes from more than one HCV polypeptide other than E1 and E2.

As one example, a T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARK-MAGGHYVQMAIIKLGALTGTYVYNALTPLRDW AHNGLRDLAVAVEPVVFSQMETKLITWGADTAACG-DIINGLPVSARRGREILLGPADG MVSKGWRLLAPI-TAYAQQTRGLLGCIITSLTGRDKNQVEGEVQI-VSTAAQTFLATCING VCWTVYHGAGTRTIAS-PKGPVIQMYTNVDQDLVGW-PAPQGARSLTPCTCGSSDLYLVT RHAD-VIPVRRRGDSRGSLLSPRPISYLKGS AGGPLLCPAGHAVGIFRAAVCTRGVAKAV DFIPVEN-LETTMRSPVFTDNSSPPAVPQSFQVAHLHAPTGSGK-STKVPAAYAAQGYKVL VLNPSVAATLGF-GAYMSKAHGIDPNIRTGVRTITTGSPITYS TYGKFLADGGCSGGAYDII ICDECHSTDATSIL-GIGTVLDQAETAGARLVVLATATPPGSVTVPHPNIE-EVALSTTGEIPF YGKAIPLEVIKGGRHLIFCHS-KKKCDELAAKLVALGINAVAYYRGLDVSVIPTSG DVVV VATDALMTGFTGDFDSVIDCN (SEQ ID NO:92); and has a length of from 550 amino acids (aa) to 560 aa (e.g., 550 aa, 551 aa, 552 aa, 553 aa, 554 aa, 555 aa, 556 aa, 557 aa, 558 aa, 559 aa, or 560 aa).

QASLLKVPYFVRVQGLLRICALARKMAGGHYVQ-MAIIKLGALTGTYVYNALTP LRDWAHNGLRDLAVA-VEPVVFSQMETKLITWGADTAACGDIINGLPVSARR-GREILLGP ADGMVSKGWRLLAPITAYAQQTRGLLGCIITSLT-GRDKNQVEGEVQIVSTAAQTFLATC INGVCWTVYHGAGTRTIAS-PKGPVIQMYTNVDQDLVGW-PAPQGARSLTPCTCGSSDLY LVTRHAD-VIPVRRRGDSRGSLLSPRPISYLKGS AGGPLLCPAGHAVGIFRAAVCTRGVAK AVDFIPVEN-LETTMRSPVFTDNSSPPAVPQSFQVAHLHAPTGSGK-STKVPAAYAAQGYK VLVLNPSVAATLGF-GAYMSKAHGIDPNIRTGVRTITTGSPIT YSTYGKFLADGGCSGGAY DIIICDECHSTDATSIL-GIGTVLDQAETAGARLVVLATATPPGSVTVPHPNIE-EVALSTTGE IPFYGKAIPLEVIKGGRHLIFCHS-KKKCDELAAKLVALGINAVAYYRGLDVSVIPTSGDV VVVATDALMTGFTGDFDSVIDCN (SEQ ID NO:92) is referred to in FIG. 10A-10B as "TP553."

Figure 11E:
Figure 11F:
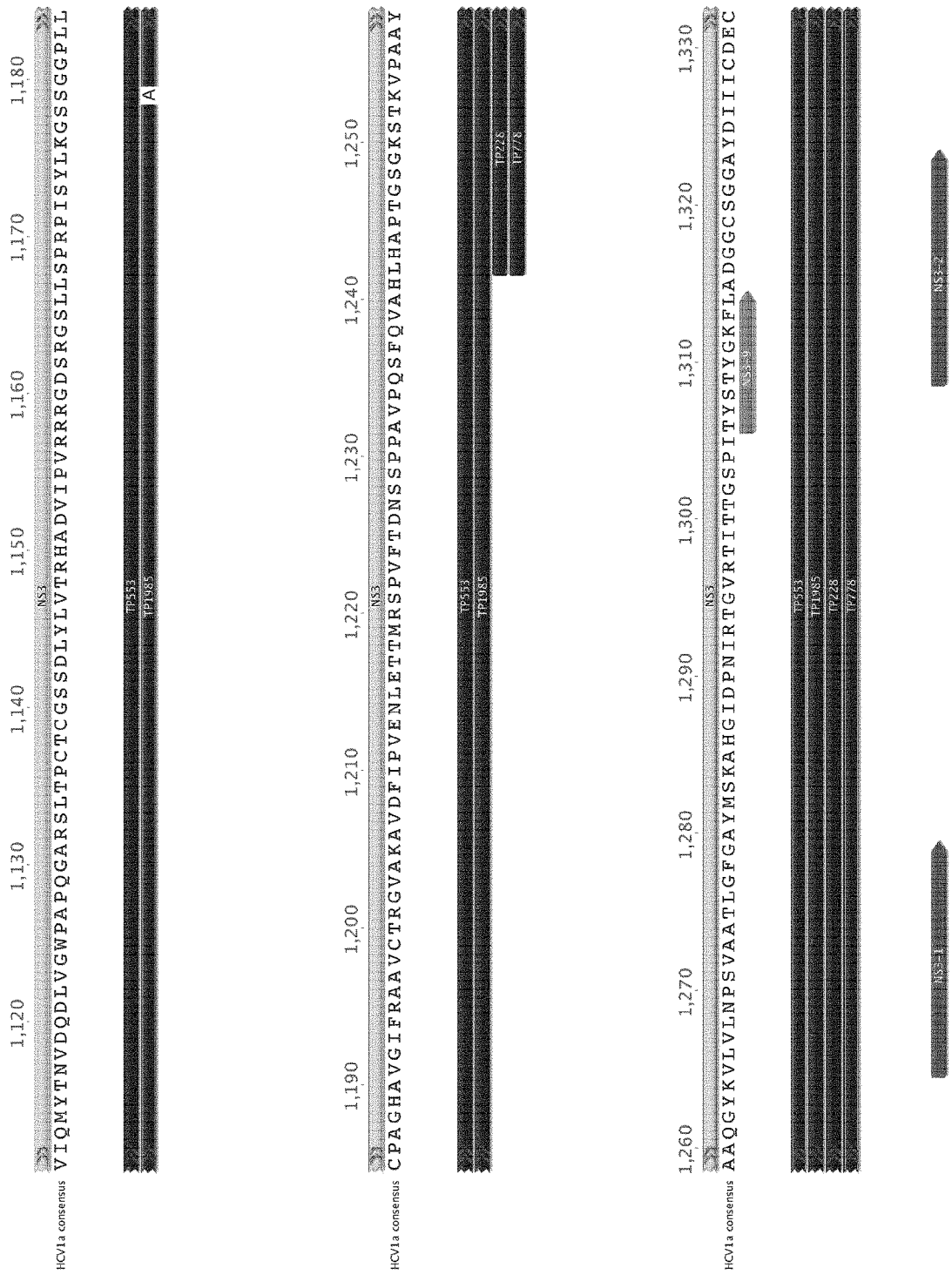
Figure 11G:
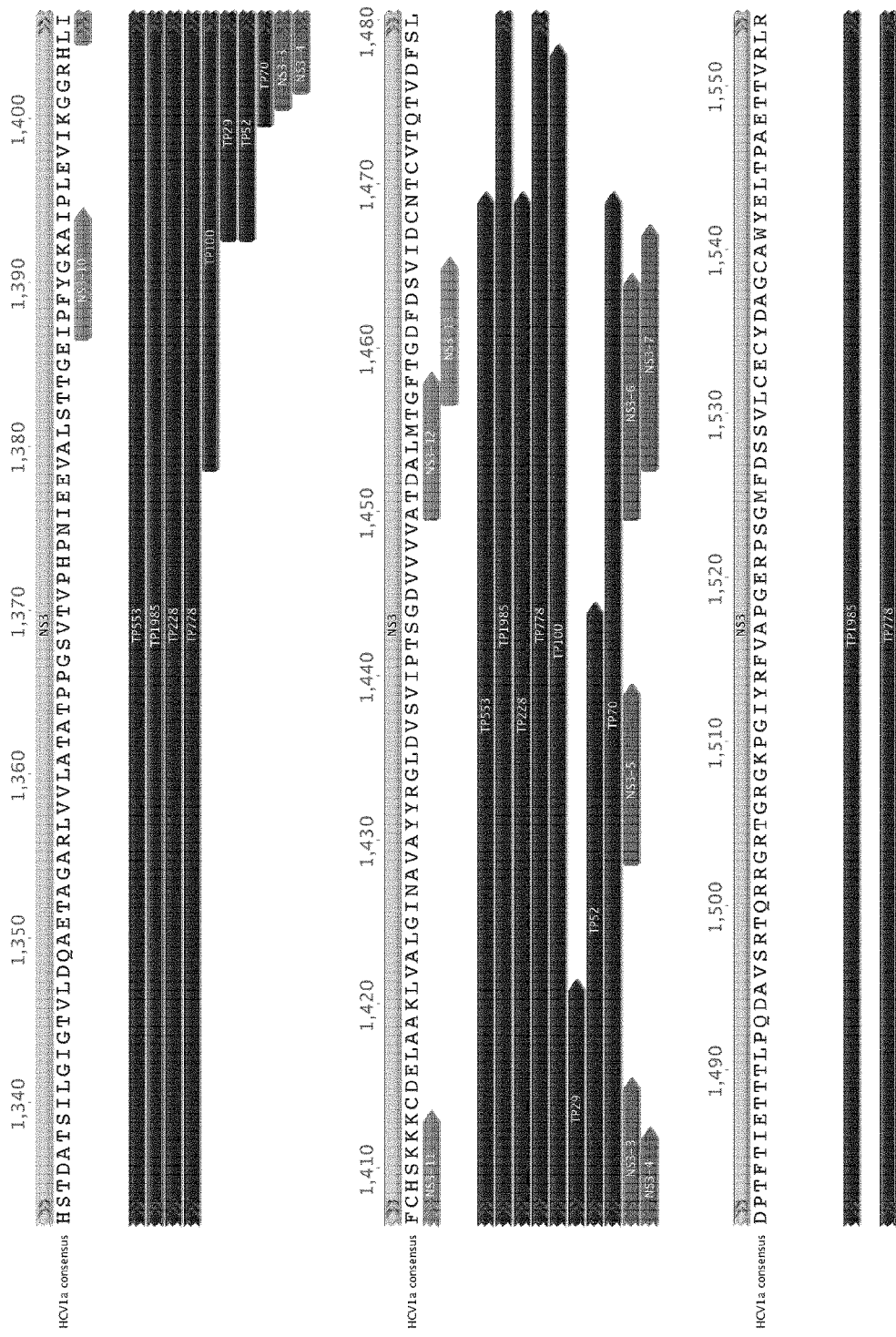
Figure 11H:
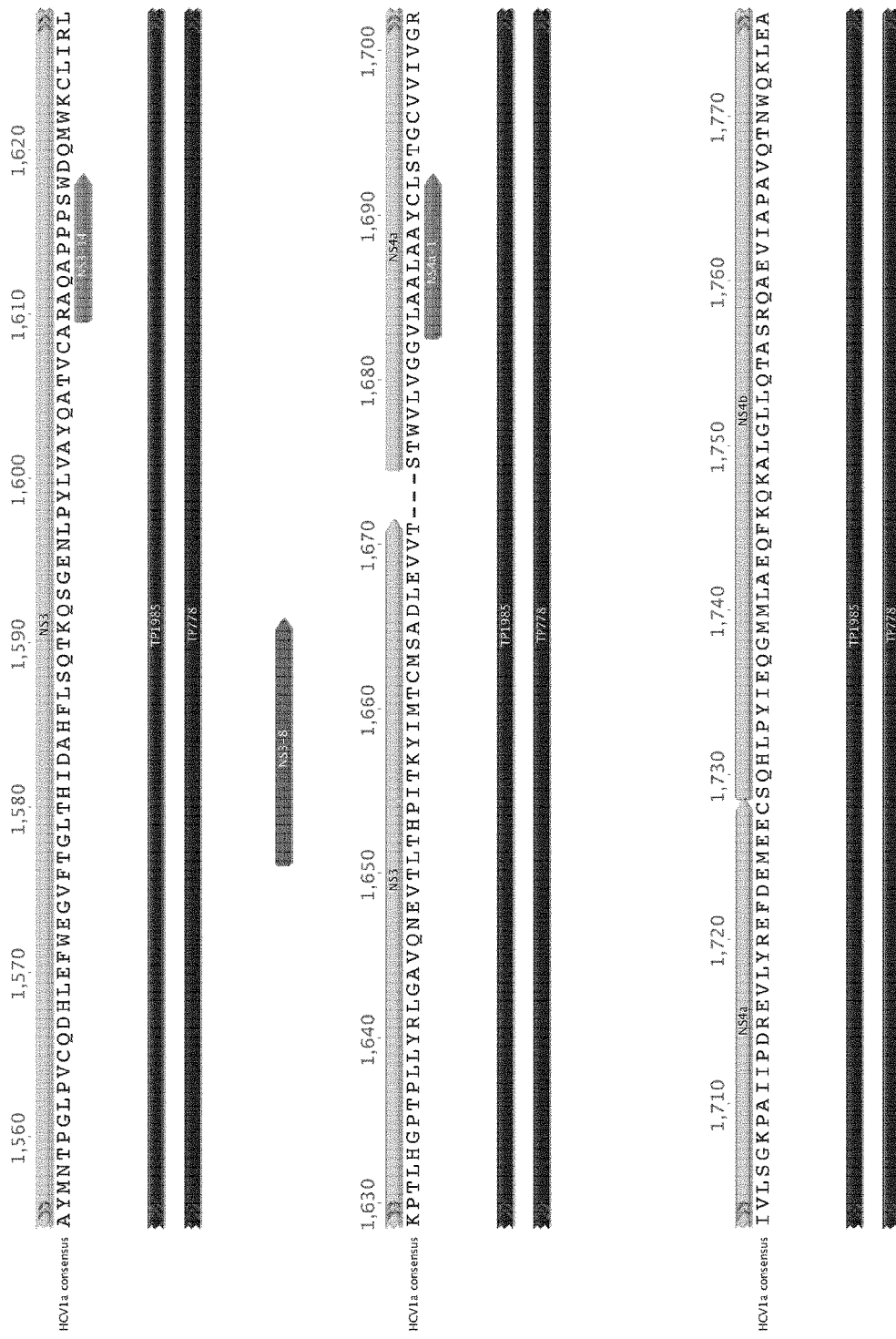
Figure 11:
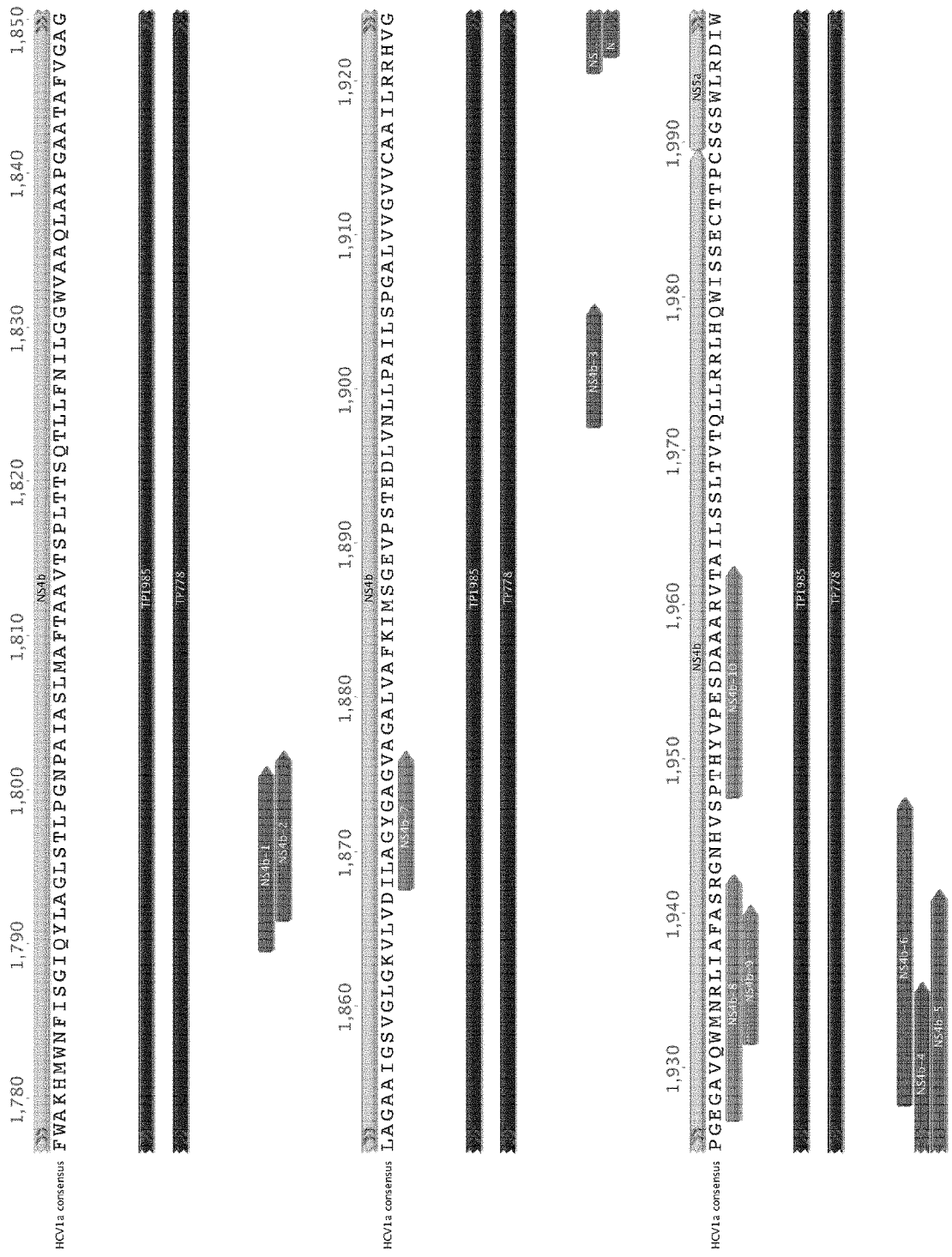
Figure 11K:
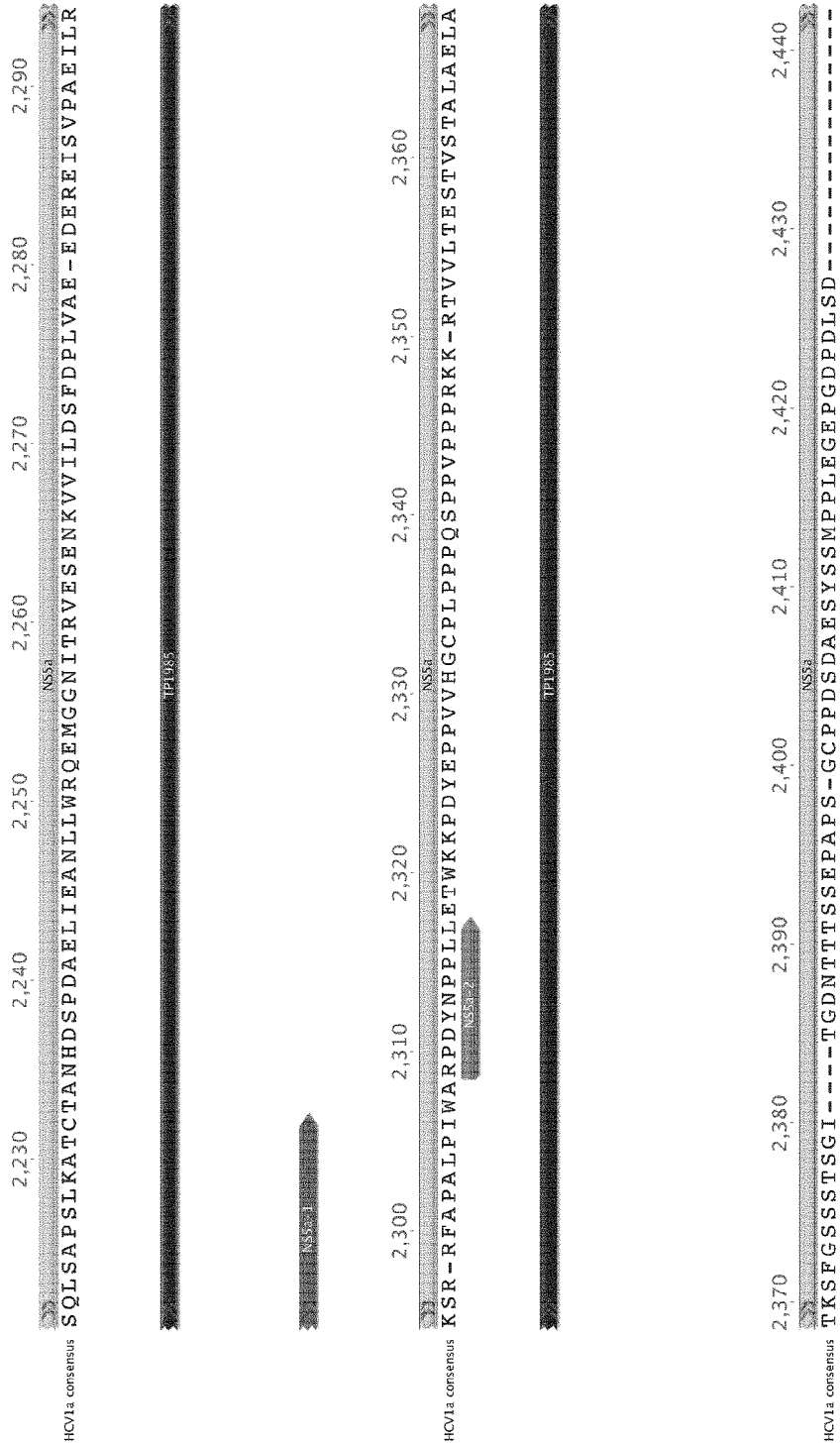
Figure 11L:
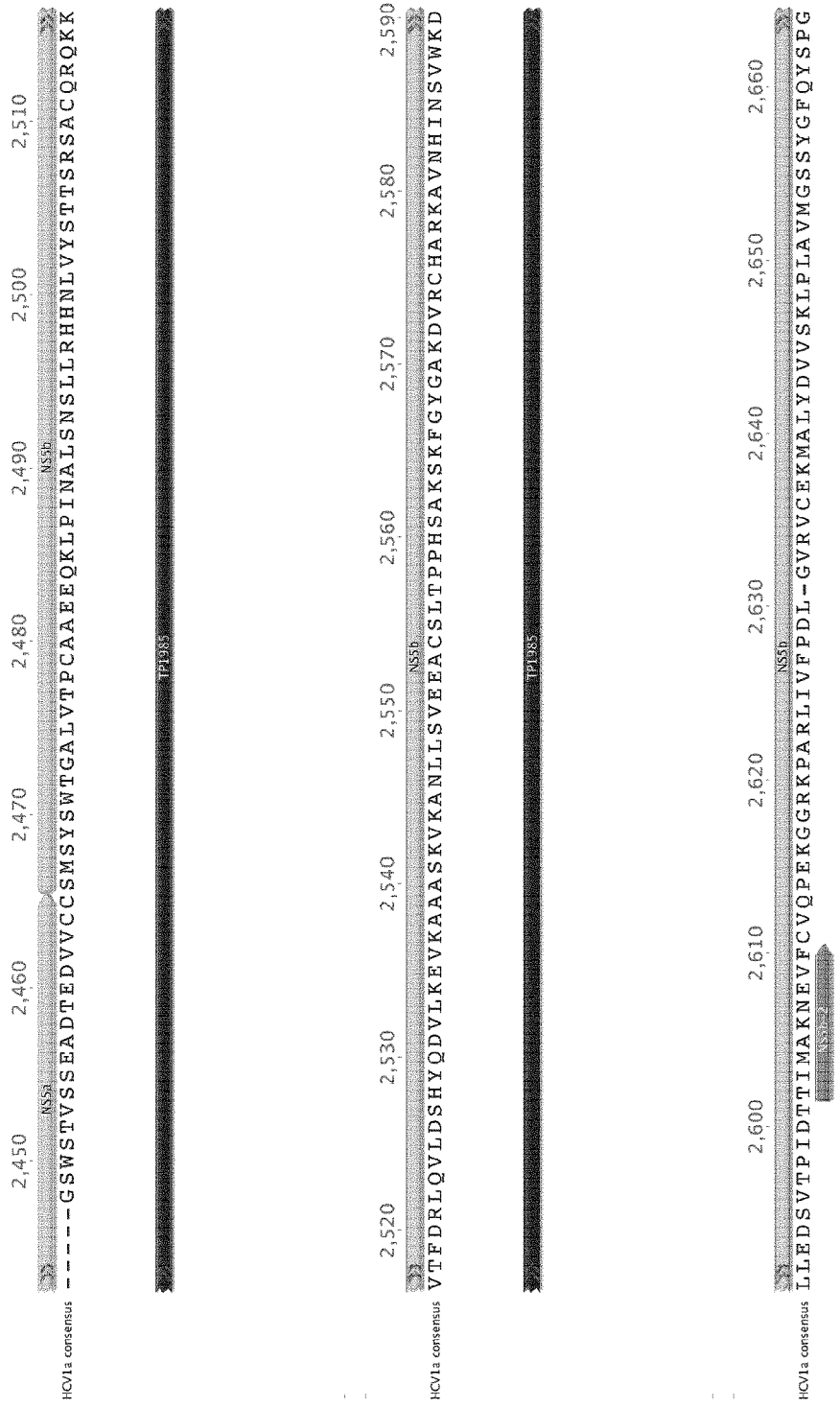
Figure 11M:
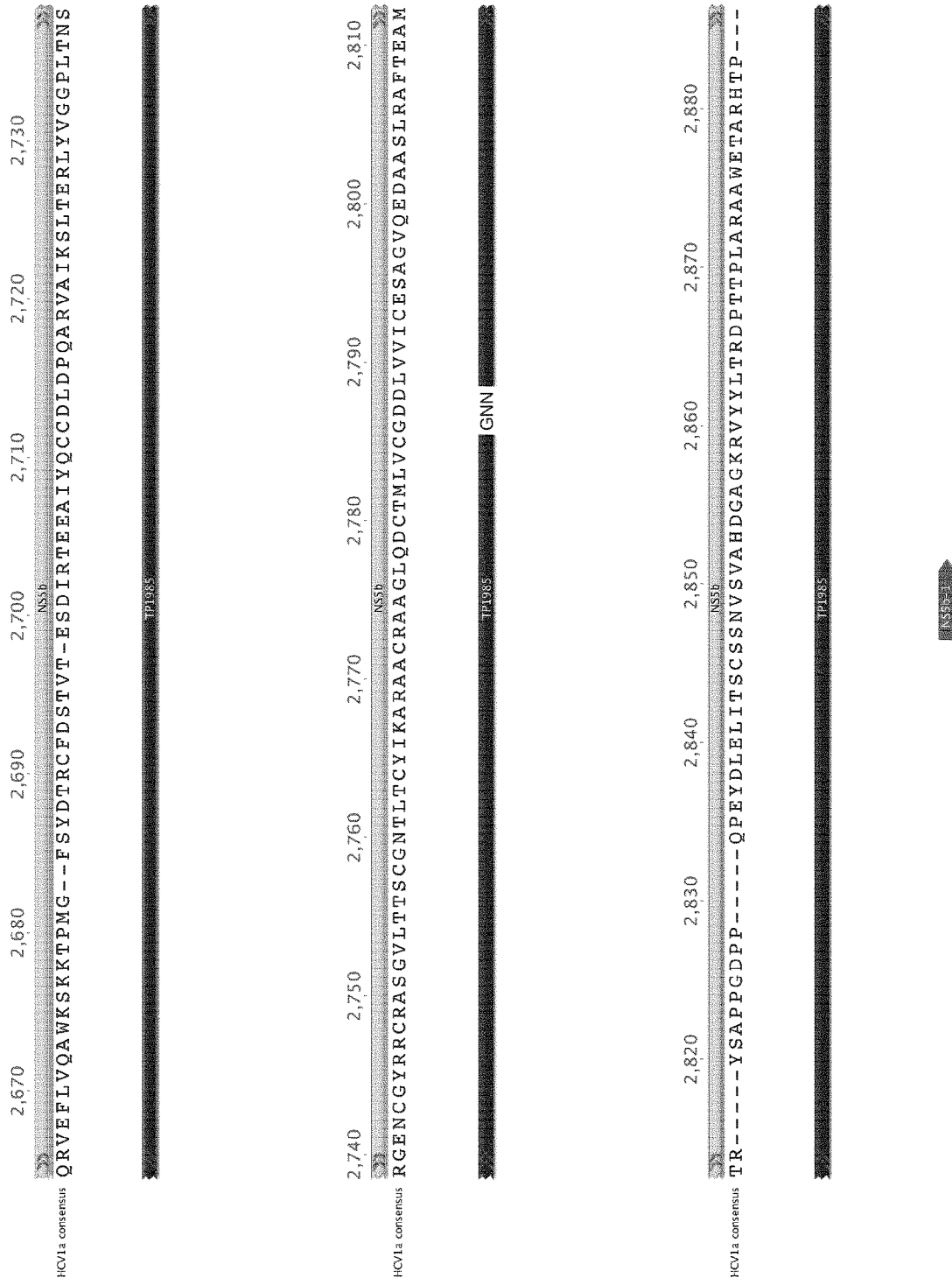
Figure 12B:
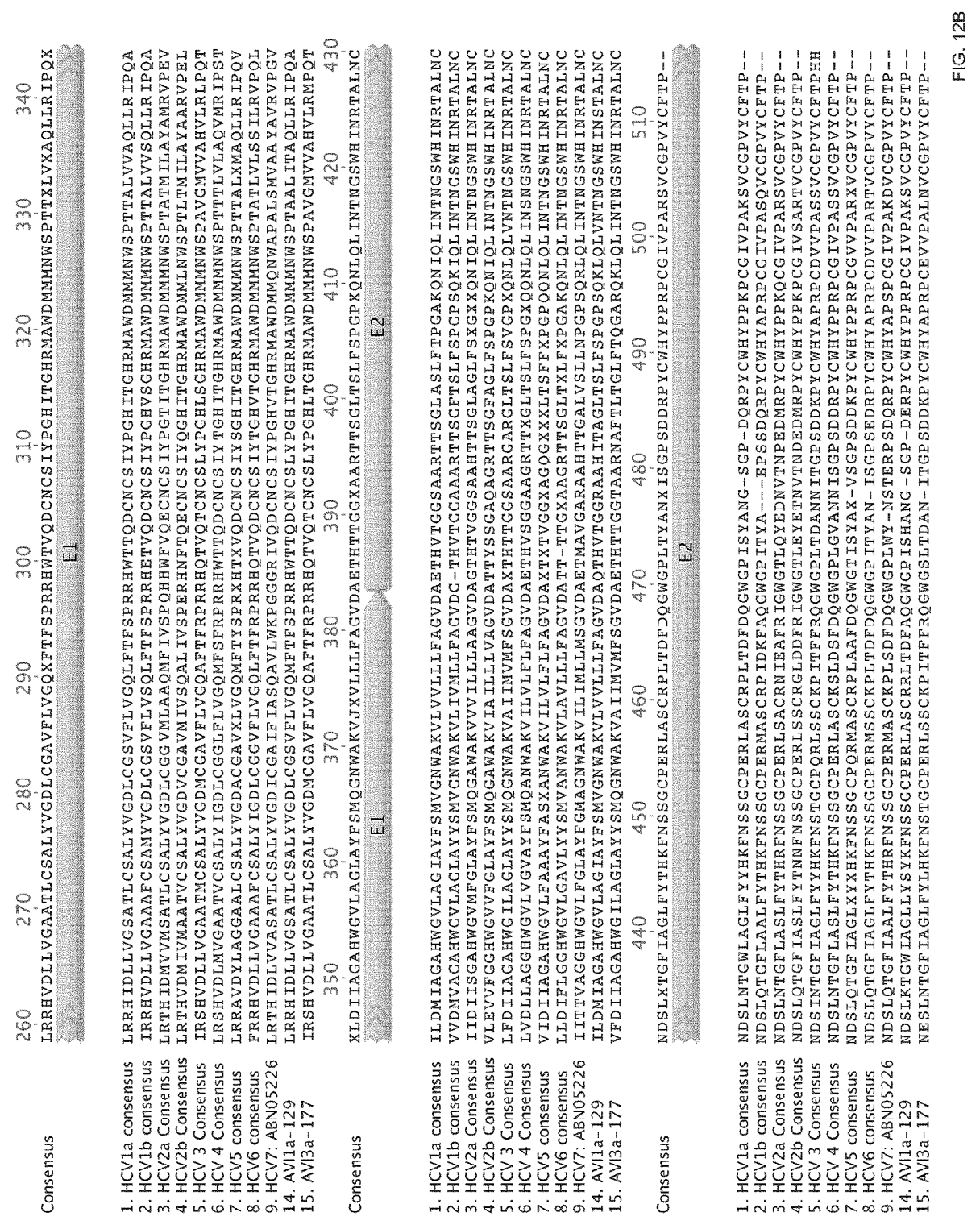
Figure 12C:
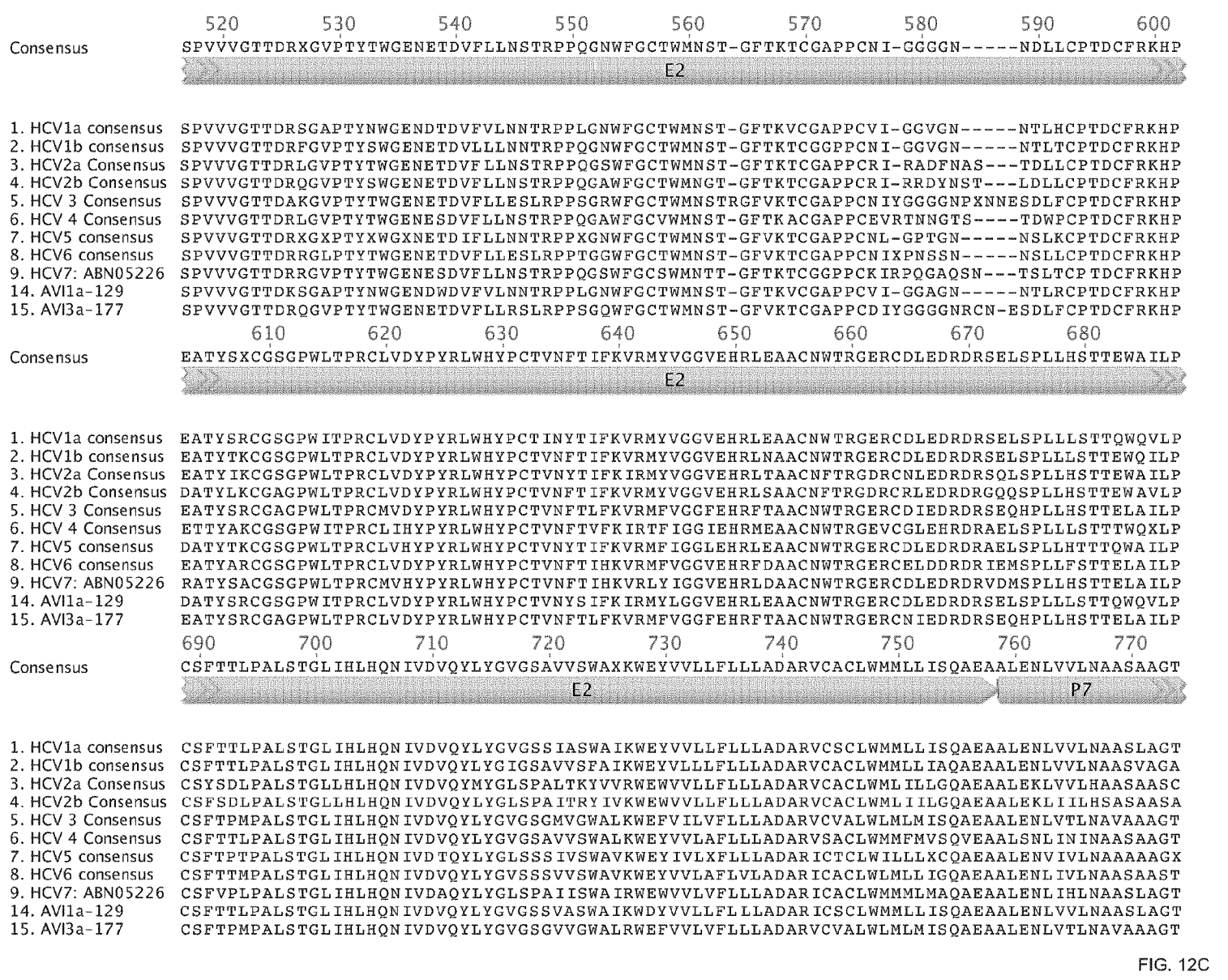
Figure 12D:
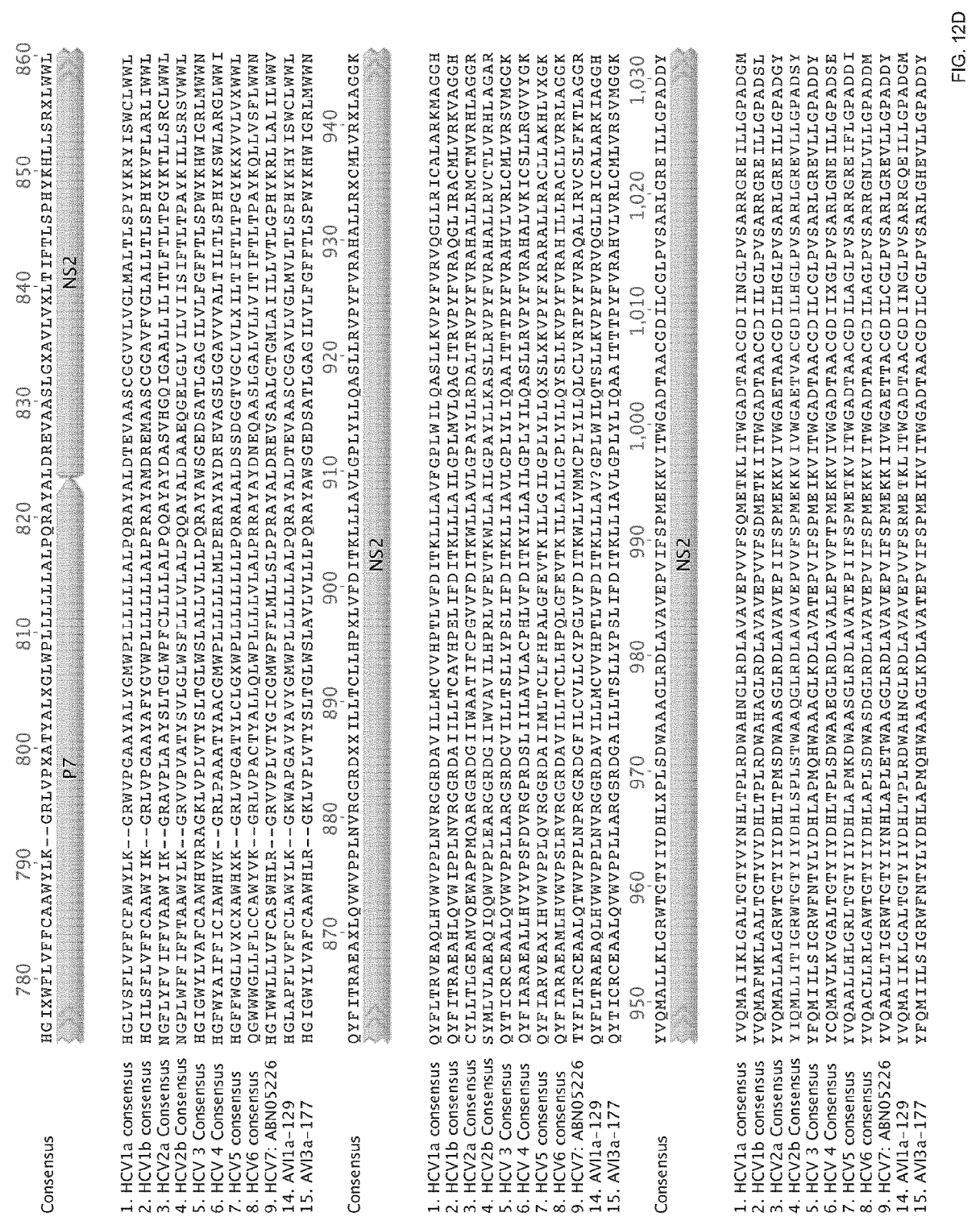
Figure 12E:
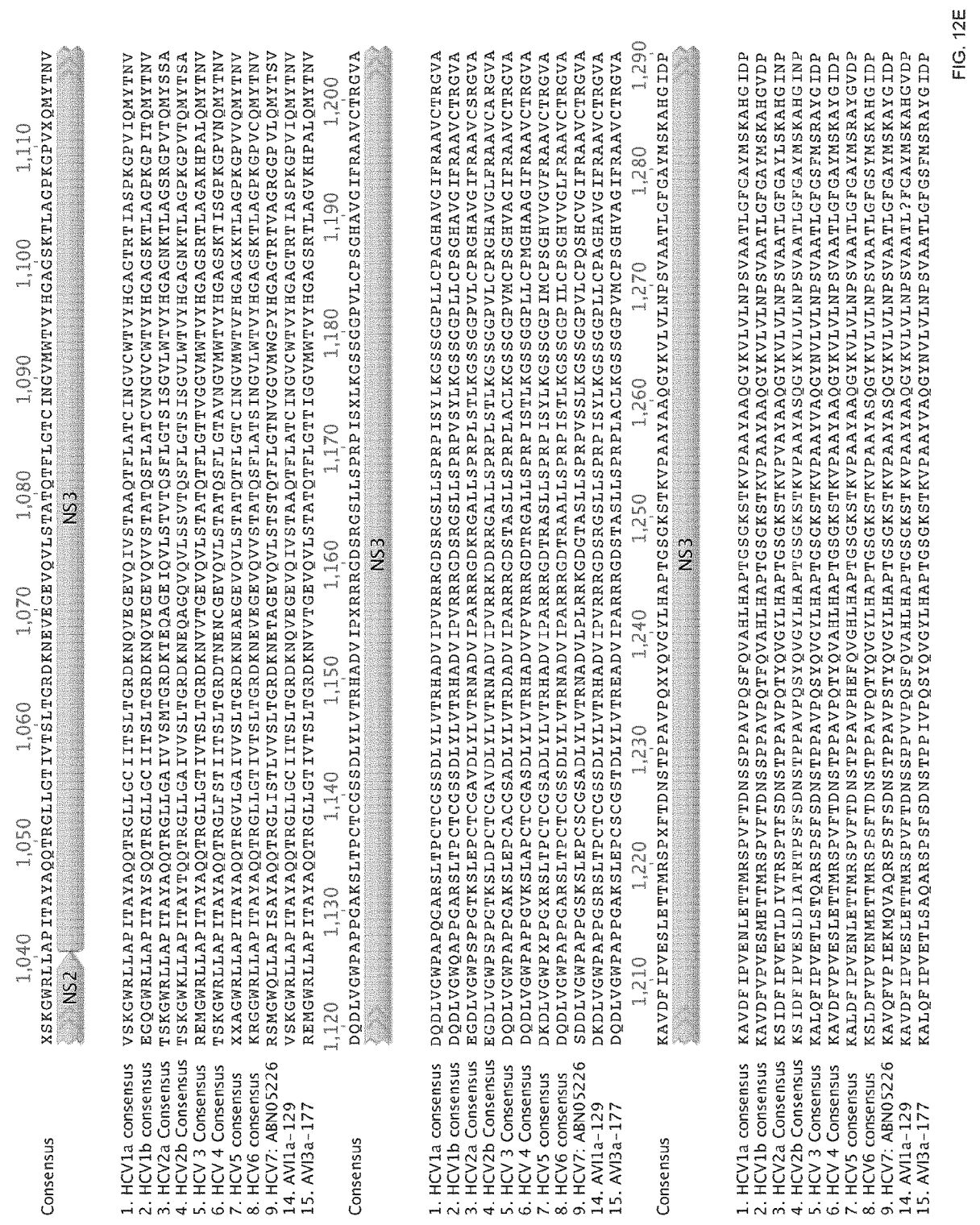
Figure 12F:
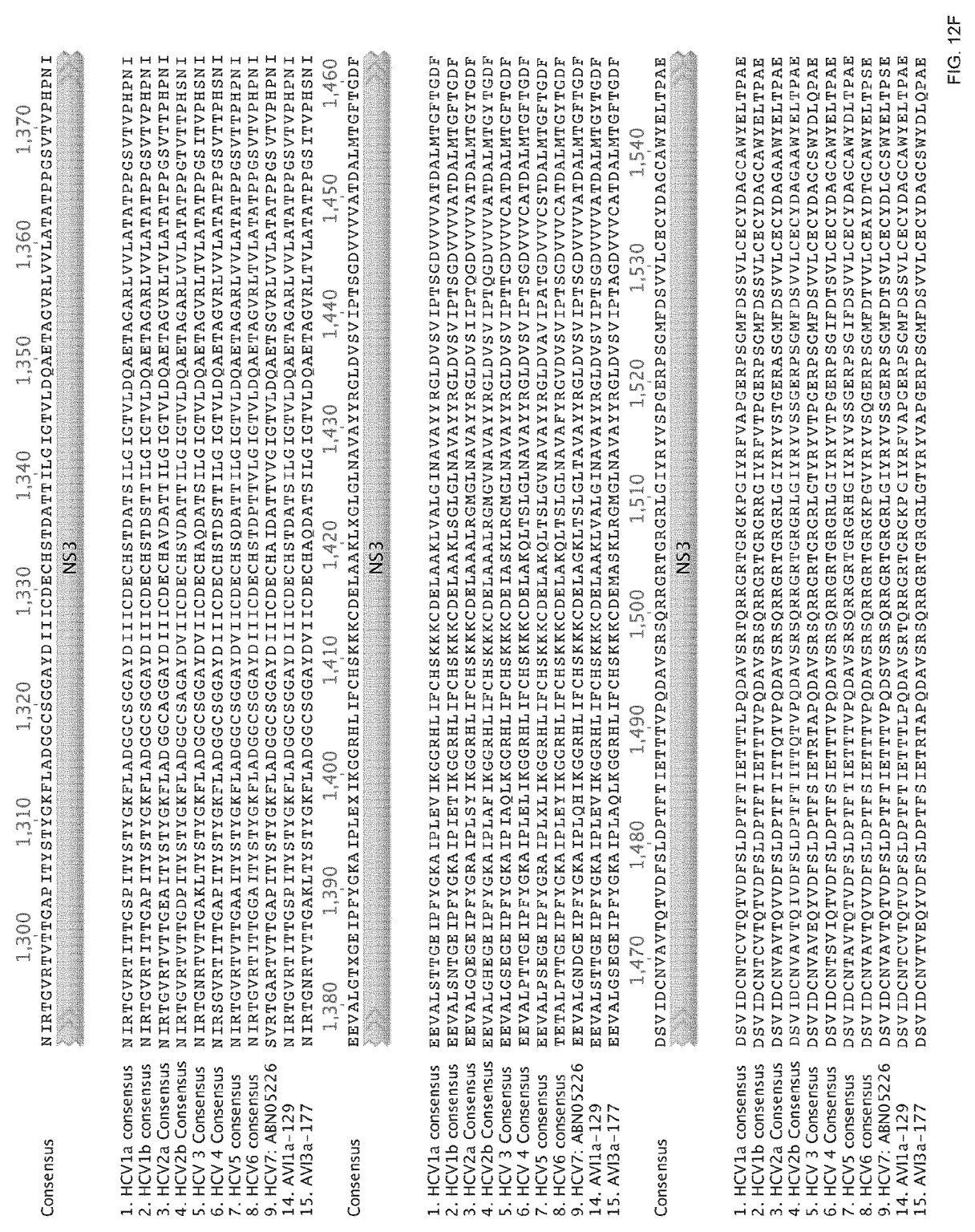
Figure 12G:
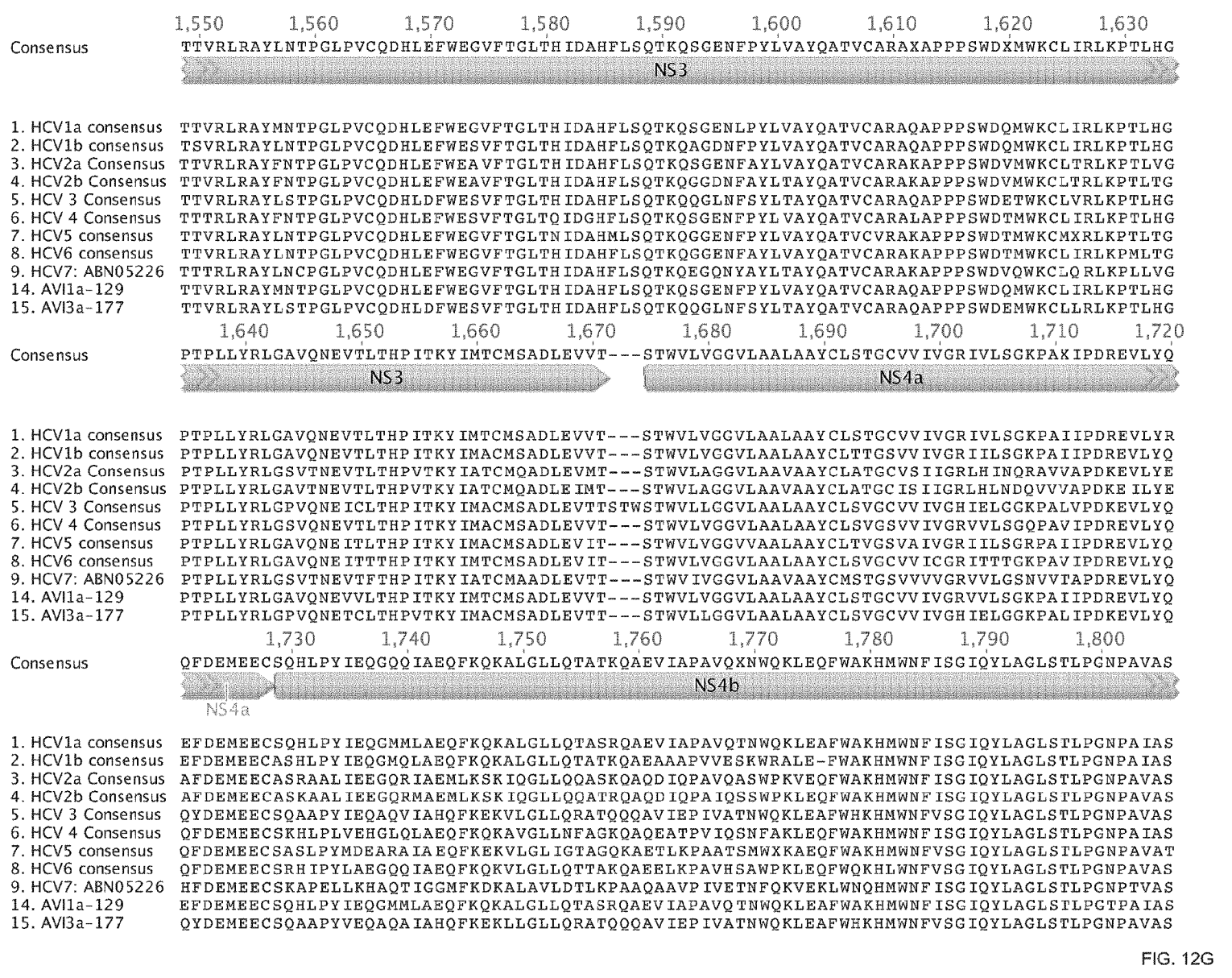
Figure 12H:
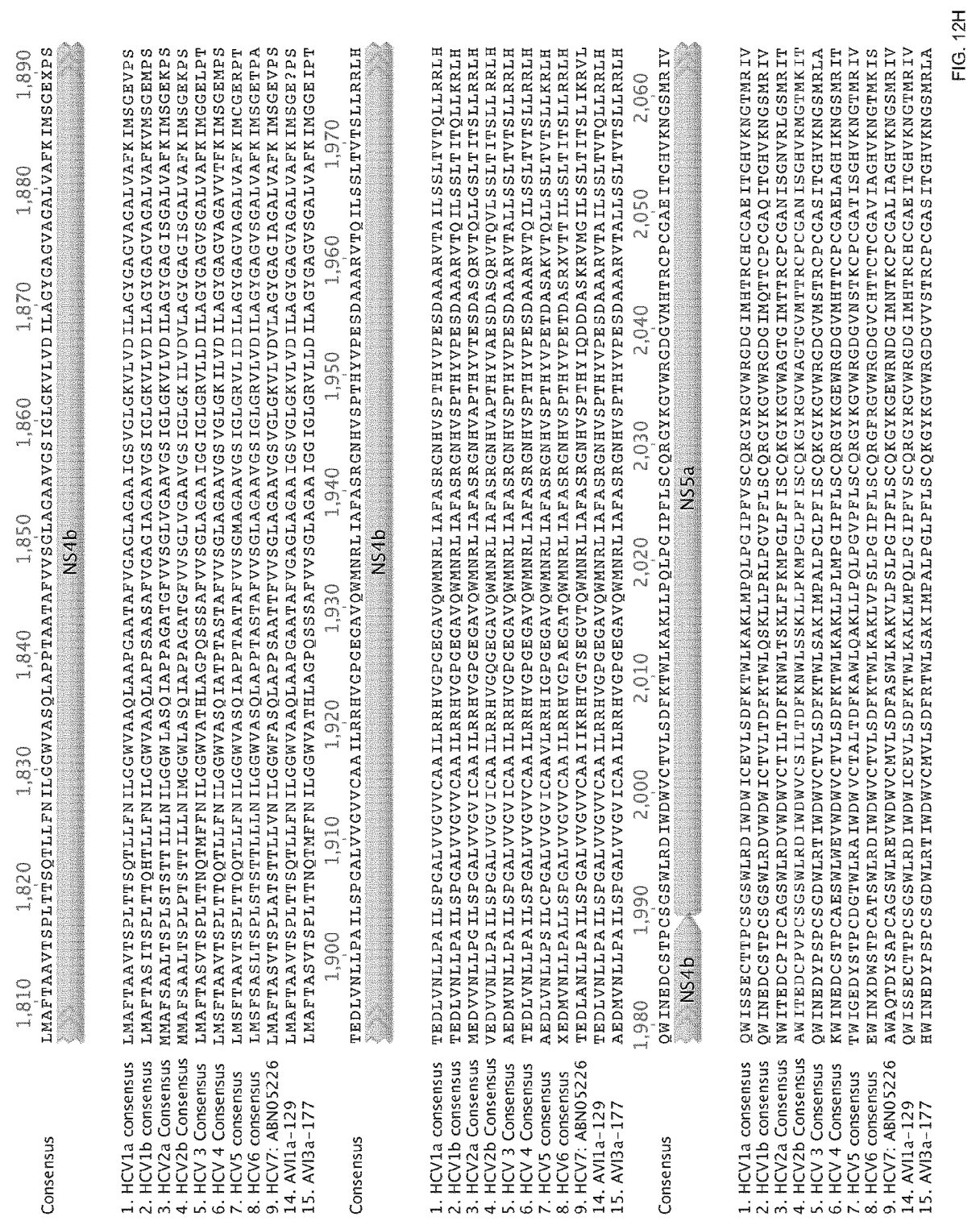
Figure 12I:
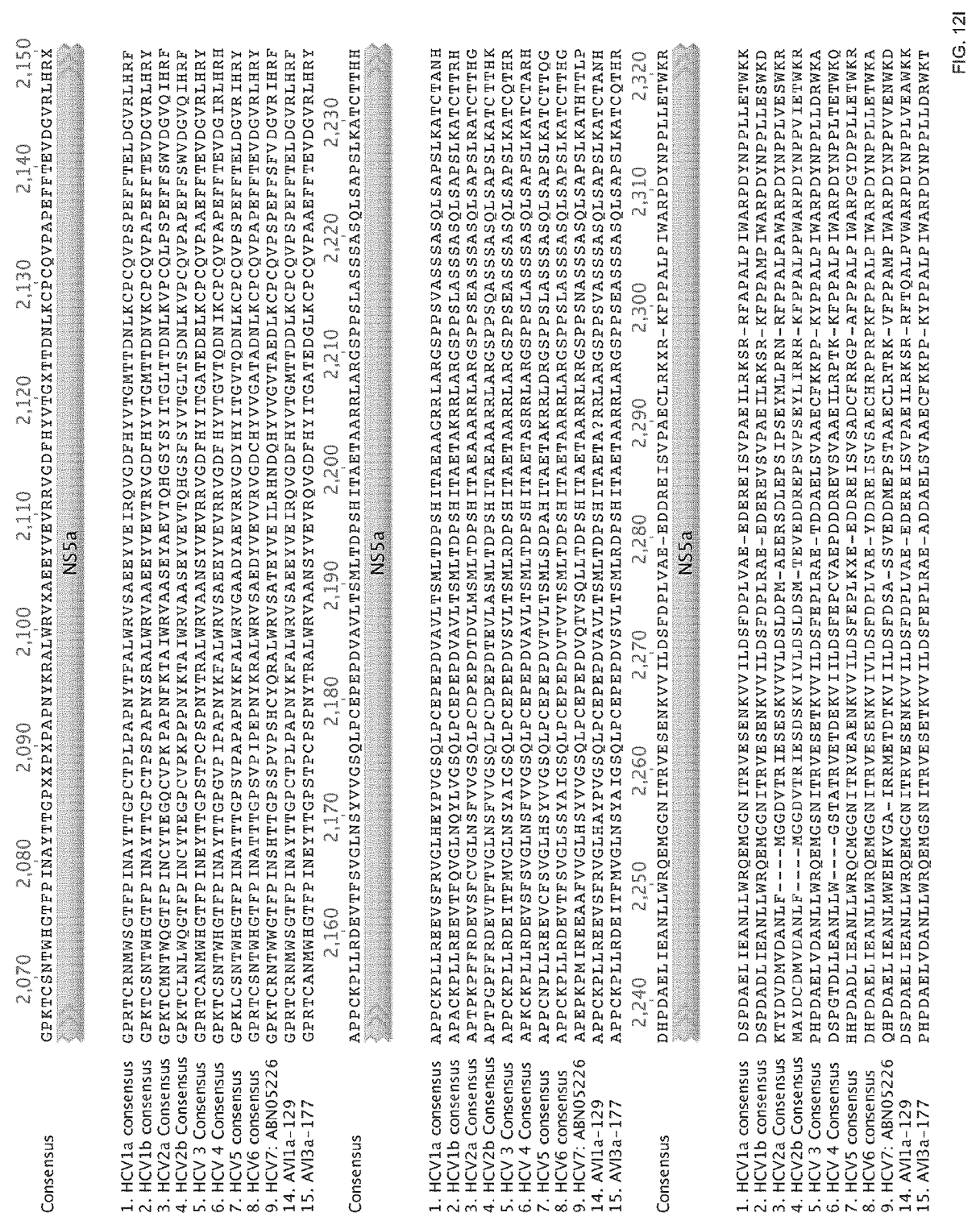
Figure 12J:
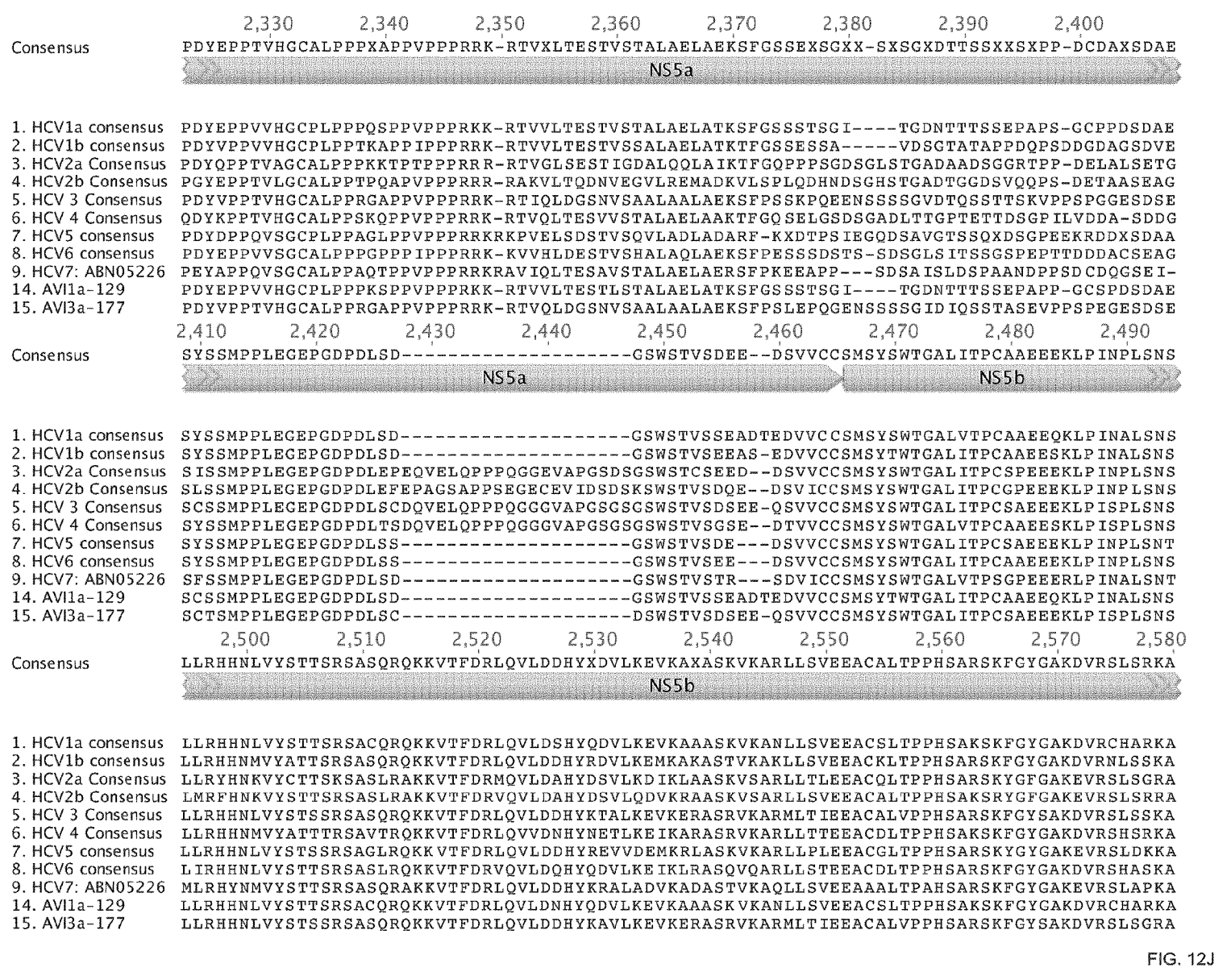
Figure 12K:
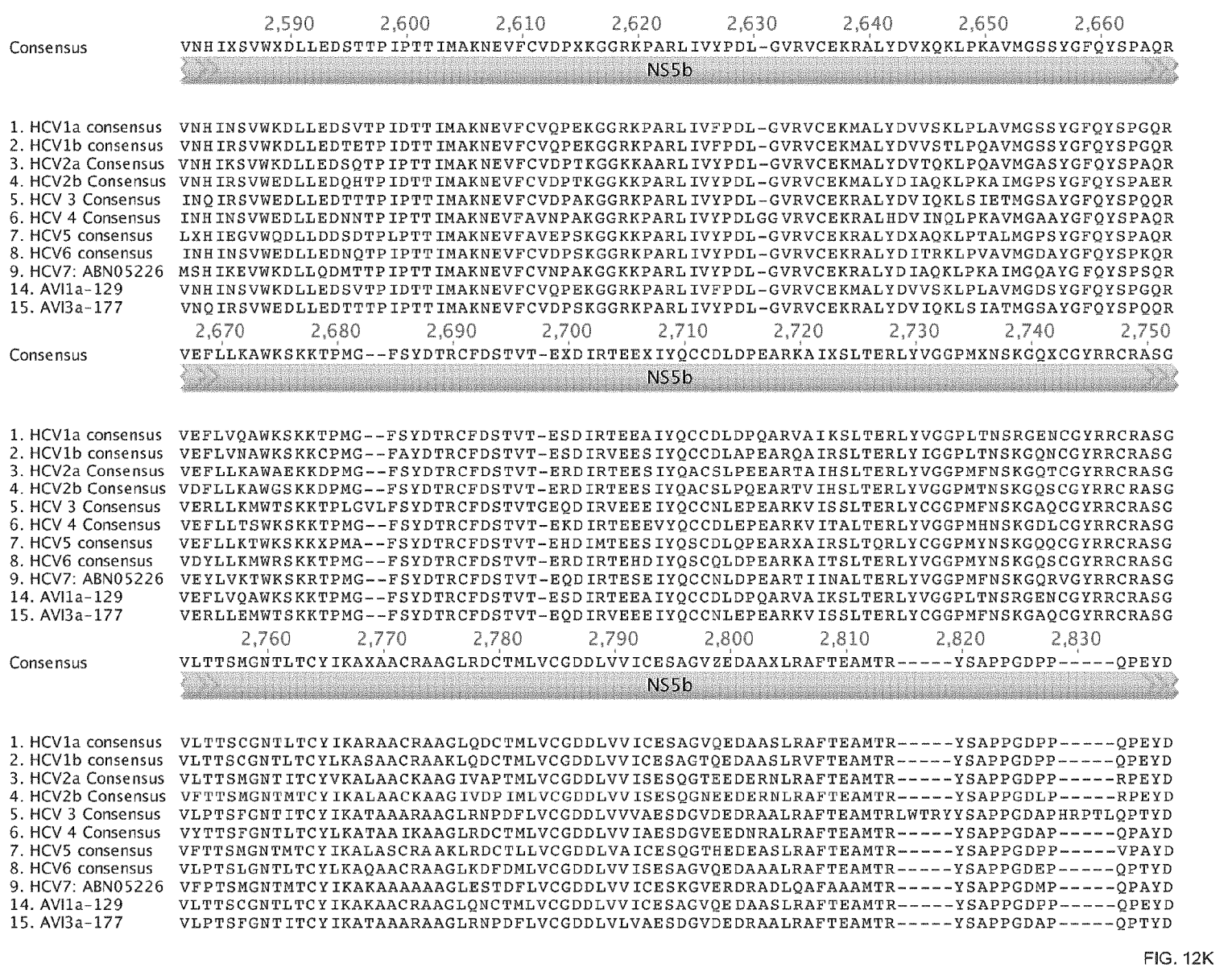

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARK-MAGGHYVQMAIIKLGALTGTYVYNALTPLRDW AHNGLRDLAVAVEPVVFSQMETKLITWGADTAACG-DIINGLPVSARRGREILLGPADG MVSKGWRLLAPI-TAYAQQTRGLLGCIITSLTGRDKNQVEGEVQI-VSTAAQTFLATCING VCWTVYHGAGTRTIAS-PKGPVIQMYTNVDQDLVGW-PAPQGARSLTPCTCGSSDLYLVT RHAD-VIPVRRRGDSRGSLLSPRPISYLKGS AGGPLLCPAGHAVGIFRAAVCTRGVAKAV DFIPVEN-LETTMRSPVFTDNSSPPAVPQSFQVAHLHAPTGSGK-STKVPAAYAAQGYKVL VLNPSVAATLGF-GAYMSKAHGIDPNIRTGVRTITTGSPITYST YGKFLADGGCSGGAYDII ICDECHSTDATSIL-GIGTVLDQAETAGARLVVLATATPPGSVTVPHPNIE-EVALSTTGEIPF YGKAIPLEVIKGGRHLIFCHS-KKKCDELAAKLVALGINAVAYYRGLDVSVIPTSGD VVV VATDALMTGFTGDFDSVIDCN (SEQ ID NO:92); and has a length of 553 amino acids. Such a polypeptide can include T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. This polypeptide is also referred to as "TP553" (FIG. 12A-12D). In order to prevent self cleavage of the TP553 polypeptide (amino acids 917-1469) (FIG. 11E-11G) at the NS2-NS3 junction that is mediated by the catalytic domain of the NS2 protease (amino acids 917-1040), the histidine at position 966 (H966), a critical residue for NS2 protease activity, is mutated to alanine (H966A) (FIG. 11E). See, e.g., Grakoui, A. et al. A second hepatitis C virus-encoded proteinase. Proc. Natl Acad. Sci. USA 90, 10583-10587 (1993); Hijikata, M. et al. Two distinct proteinase activities required for the processing of a putative nonstructural precursor protein of hepatitis C virus. J. Virol. 67, 4665-4675 (1993); and Lorenz. I C. Structure of the catalytic domain of the hepatitis C virus NS2-3 protease. Nature. August 17; 442(7104):831-5 (2006).

As another example, the T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIG TVLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDS VIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLR DIWDWICEVLSDFKTW LKAKLMPQLPG (SEQ ID NO:93); and has a length of from 778 amino acids (aa) to 790 aa (e.g., 778 aa, 779 aa, 780 aa, 781 aa, 782 aa, 783 aa, 784 aa, 785 aa, 786 aa, 787 aa, 788 aa, or 790 aa). LHAPTGSGKSTKVPAAYAAQGYKVLVLNPSVAATLGFGAYMSKAHGIDPNIRT GVRTITTGSPITYSTYGKFLADGGCSGGAYDIIICDECHSTDATSILGIG TVLDQAETAGA RLVVLATATPPGSVTVPHPNIEEVALSTTGEIPFYGKAIPLEVIKGGRHLIFCHSKKKCDE LAAKLVALGINAVAYYRGLDVSVIPTSGDVVVVATDALMTGFTGDFDSVIDCNTCVTQ TVDFSLDPTFTIETTTLPQDAVSRTQRRGRTGRGKPGIYRFVAPGERPSGMFDSSVLCEC YDAGCAWYELTPAETTVRLRAYMNTPGLPVCQDHLEFWEGVFTGLTHIDA HFLSQTKQ SGENLPYLVAYQATVCARAQAPPPSWDQMWKCLIRLKPTLHGPTPLLYRLGAVQNEVT LTHPITKYIMTCMSADLEVVTSTWVLVGGVLAALAAYCLSTGCVVIVGR IVLSGKPAIIP DREVLYREFDEMEECSQHLPYIEQGMMLAEQFKQKALGLLQTASRQAEVIAPAVQTNW QKLEAFWAKHMWNFISGIQYLAGLSTLPGNPAIASLMAFTAAVTSPLTTSQTLLFNILGG WVAAQLAAPGAATAFVGAGLAGAAIGSVGLGKVLVDILAGYGAGVAGALVAFKIMSG EVPSTEDLVNLLPAILSPGALVVGVVCAAILRRHVGPGEGAVQWMNRLIAFASRGNHVS PTHYVPESDAAARVTAILSSLTVTQLLRRLHQWISSECTTPCSGSWLRDIWDWICEVLSD FKTWLKAKLMPQLPG (SEQ ID NO:93) is referred to in FIG. 10B as "TP778."

In some cases, the T cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) of the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGT VLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:93); and has a length of from 25 amino acids (aa) to 50 aa, from 50 aa to 100 aa, from 100 aa to 200 aa, from 200 aa to 300 aa, from 300 aa to 400 aa, from 400 aa to 500 aa, from 500 aa to 600 aa, from 600 aa to 700 aa, or from 700 aa to 778 aa. In some cases, the T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGT VLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:93); and has a length of 778 amino acids. Such a polypeptide can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS2-14, NS4a-1, NS4b-1, NS4b-2, NS4b-3, NS4b-4, NS4b-5, NS4b-6, NS4b-7, NS4b-8, NS4b-9, and NS4b-10 in FIG. 9B and FIG. 11A-11N.

As another example, the T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 1985 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 500 aa, from 500 aa to 750 aa, from 750 aa to 1000 aa, from 1000 aa to 1500 aa, or from 1500 aa to 1985 aa) of the following amino acid sequence: APITAYAQQTRGLLGCIITSLTGRDKNQVEGEVQIVSTAAQTFLATCINGVCWTVYHGA GTRTIASPKGPVIQMYTNVDQDLVGWPAPQG ARSLTPCTCGSSDLYLVTRHADVIPVRR RGDSRGSLLSPRPISYLKGS AGGPLLCPAGHAVGIFRAAVCTRGVAKAVD FIPVENLETT MRSPVFTDNSSPPAVPQSFQVAHLHAPTGSGKSTKVPAAYAAQGYKVLVLNPSVAATL GFGAYMSKAHGIDPNIRTGVRTITTGSPITYSTYGKFLADGGCSGGAYDIIICDECHSTDA TSIL-GIGTVLDQAETAGARLVVLATATPPGSVTVPHPNIEEVALSTTGEIPFYGKAIPLEVI KGGRHLIFCHSKKKCDELAAKLVALGINAVAYYRGLDVSVIPTSGDVVVVATDALMTG FTGDFDSVIDCNTCVTQTVDDSLDPTFTIETTTLPQDAVSRTQRRGRTGRGKPGIYRFVAP GERPSGMFDSSVLCECYDAGCAWYELTPAETTVRLRAYMNTPGLPVCQDHLEFWEGV FTGLTHIDAHFLSQTKQSGENLPYLVAYQATVCARAQAPPPSWDQMWKCLIRLKPTLH GPTPLLYRLGAVQNEVTLTHPITKYIMTCMSADLEVVTSTWVLVGGVLAALAAYCLST GCVVIVGRIVLSGKPAIIPDREVLYREFDEMEECSQHLPYIEQGMMLAEQFKQKALGLLQ TASRQAEVIAPAVQTNWQKLEAFWAKHMWNFISGIQYLAGLSTLPGNPAIASLMAFTA AVTSPLTTSQTLLFNILGGWVAAQLAAPGAATAFVGAGLAGAAIGSVGLGKVLVDILAG YGAGVAGALVAFKIMSGEVPSTEDLVNLLPAILSPGALVVGVVCAAILRRHVGPGEGAV QWMNRLIAFASRGNHVSPTHYVPESDAAARVTAILSSLTVTQLLRRLHQWISSECTTPCS GSWLRDIWDWICEVLSDFKTWLKAKLMPQLPGIPFVSCQRGYRGVWRGDGIMHTRCH CGAEITGHVKNGTMRIVGPRTCRNMWSGTFPINAYTTGPCTPLPAPNYTFALWRVSAEE YVEIRQVGDFHYVTGMTTDNLKCPCQVPSPEFFTELDGVRLHRFAPPCKPLLREEVSFR VGLHEYPVGSQLPCEPEPDVAVLTSMLTDPSHITAEAAGRRLARGSPPSVASSSASQLSA PSLKATCTANHDSPDAELIEANLLWRQEMGGNITRVESENKVVILDSFDPLVAEEDEREI SVPAEILRKSRRFAPALPIWARPDYNPPLLETWKKPDYEPPVVHGCPLPPPQSPPVPPPRK KRTVVLTESTVSTALAELATKSFGSSSTSGITGDNTTTSSEPAPSGCPPDSDAESYSSMPP LEGEPGDPDLSDGSWSTVSSEADTEDVVCCSMSYSWTGALVTPCAAEEQKLPINALSNS LLRHHNLVYSTTSRSACQRQKKVTFDRLQVLDSHYQDVLKEVKAAASKVKANLLSVEE ACSLTPPHSAKSKFGYGAKDVRCHARKAVNHINSVWKDLLEDSVT-PIDTTIMAKNEVFC VQPEKGGRKPARLIVFPDLGVRVCEKMALYDVVSKLPLAVMGSSYGFQYSPGQRVEFL VQAWKSKKTPMGFSYDTRCFDSTVTESDIRTEEAIYQCCDLDPQARVAIKSLTERLYVG GPLTNSRGENCGYRRCRASGVLTTSCGNTLTCYIKARAACRAAGLQDCTMLVCGNNLV VICESAGVQEDAASLRAFTEAMTRYSAPPGDPPQPEYDLELITSCSSNVSVAHDGAGKR VYYLTRDPTTPLARAAWETARHTPVNSWLGNIIMFAPTLWARMILMTHFFSVLIARDQL EQALDCEIYGACYSIEPLDLPPIIQRLHGLSAFSLHSYSPGEINRVAACLRKLGVPPLRAW RFIRARSVRARLLSRGGRAAICGKYLFNWAVRTKLKLTPIAAAGQLDLSGWFTAGYSGG DIYHSVSHARPRWFWFCLLLLAAGVGIYLLPNR (SEQ ID NO:94); this polypeptide is also referred to as "TP1985" and is depicted in FIG. 10C.

In some cases, the T cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: APITAYAQQTRGLLGCIITSLTGRDKNQVEGEVQIVSTAAQTFLATC- INGVCWTVYHGA GTRTIAS-PKGPVIQMYTNVDQDLVGWPAPQGARSLTPCTCGSSD-LYLVTRHADVIPVRR RGDSRGSLLSPRPISYLKGS AGGPLLCPAGHAVGIFRAAVCTRGVAKAVDFIPVE NLETT MRSPVFTDNSSPPAVPQSFQVAHLHAP-TGSGKSTKVPAAYAAQGYKVLVLNPSVAATL GFGAYMSKAHGIDPNIRTGVRTITTGSPITYSTYGK-FLADGGCSGGAYDIIICDECHSTDA TSIL-GIGTVLDQAETAGARLVVLATATPPGSVTVPHPNIE-EVALSTTGEIPFYGKAIPLEVI KGGRHLIFCHSKKKCDELAAKLVALGINAVAYYR-GLDVSVIPTSGDVVVVATDALMTG FTGDFDSVIDCNTCVTQTVDFSLDPTFTIETTTLPQ-DAVSRTQRRGRTGRGKPGIYRFVAP GERPSGMFDSSVLCECYDAGCAWYELTPAETTVRL-RAYMNTPGLPVCQDHLEFWEGV FTGLTHI-DAHFLSQTKQSGENLPYLVAYQATVCAR-AQAPPPSWDQMWKCLIRLKPTLH GPTPLLYRLGAVQNEVTLTHPITKYIMTCMSA-DLEVVtSTWVLVGGVLAALAAYCIST GCV-VIVGRIVLSGKPAIIPDREVLYREFDE-
MEECSQHLPYIEQGMMLAEQFKQKALGLLQ
TASRQAEVIAPAVQTNWQKLEAFWAKHMWNFIS-
GIQYLAGLSTLPGNPAIASLMAFTA AVT-
SPLTTSQTLLFNILGGWVAAQLAAPGAATAFVGAGL-
AGAAIGSVGLGKVLVDILAG
YGAGVAGALVAFKIMSGEVPSTEDLVNLLPAILSP-
GALVVGVVCAAILRRHVGPGEGAV QWMNRLIAFAS-
RGNHVSPTHYVPESDAAARV-
TAILSSLTVTQLLRRLHQWISSECTTPCS
GSWLRDIWDWICEVLSDFKTWLKAKLMPQLP-
GIPFVSCQRGYRGVWRGDGIMHTRCH
CGAEITGHVKNGTMRIVGPRTCRNMWSGTFPINAY-
TTGPCTPLPAPNYTFALWRVSAEE
YVEIRQVGDFHYVTGMTTDNLKCPCQVPSPEF-
FTELDGVRLHRFAPPCKPLLREEVSFR VGLHEY-
PVGSQLPCEPEPDVAVLTSMLTDPSHITAEAAGRR-
LARGSPPSVASSSASQLSA
PSLKATCTANHDSPDAELIEANLLWRQEMGGNITR-
VESENKVVILDSFDPLVAEEDEREI SVPAEILRKSRR-
FAPALPIWARPDYNPPL-
LETWKKPDYEPPVVHGCPLPPPQSPPVPPPRK
KRTVVLTESTVSTALAELATKSFGSSST-
SGITGDNTTTSSEPAPSGCPPDSDAESYSSMPP
LEGEPGDPDLSDGSWSTVSSEADTEDVVCCSMSYS-
WTGALVTPCAAEEQKLPINALSNS
LLRHHNLVYSTTSRSACQRQKKVTFDRLQVLDSHY-
QDVLKEVKAAASKVKANLLSVEE ACSLTPPHSAK-
SKFGYGAKDVRCHARKAVNHINSVWKDLLEDSVT-
PIDTTIMAKNEVFC
VQPEKGGRKPARLIVFPDLGVRVCEKMALYDVVSK-
LPLAVMGSSYGFQYSPGQRVEFL VQAWK-
SKKTPMGFSYDTRCFDSTVTESDIRTEE-
AIYQCCDLDPQARVAIKSLTERLYVG
GPLTNSRGENCGYRRCRASGVLTTSCGNTLTCYIK-
ARAACRAAGLQDCTMLVCGNNLV VIC-
ESAGVQEDAASLRAFTEAMTRYSAPPGDPPQPEY-
DLELITSCSSNVSVAHDGAGKR
VYYLTRDPTTPLARAAWETARHTPVN-
SWLGNIIMFAPTLWARMILMTHFFSVLIARDQL
EQALDCEIYGACYSIEPLDLPPIIQRLHGLSAFSLH-
SYSPGEINRVAACLRKLGVPPLRAW
RHRARSVRARLLSRGGRAAICGKYLFNWAV-
RTKLKLTPIAAAGQLDLSGWFTAGYSGG
DIYHSVSHARPRWFWFCLLLLAAGVGIYLLPNR (SEQ ID NO:94); and has a length of 1985 amino acids. Such a polypeptide can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 in FIG. 9A-9B and FIG. 11A-11N.

Additional T-Cell Epitopes

As discussed above, an immunogenic composition of the present disclosure includes: a) an HCV E1/E2 heterodimer; b) a T cell epitope polypeptide that comprises one or more T-cell epitopes (e.g., one or more T cell epitopes present in an HCV polypeptide other than an HCV E1 polypeptide or an HCV E2 polypeptide); and c) a CDN. The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the T cell epitope polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein.

Thus, in some cases, an immunogenic composition of the present disclosure includes: a) an HCV E1/E2 heterodimer; b) a T-cell epitope polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein; and c) a CND.

A T helper tetanus toxin epitope or other bacterial T-cell epitope could be fused (e.g., by recombinant expression) or chemically conjugated to the T cell epitope polypeptide, or can be unconjugated (e.g., provided as a separate polypeptide), to further enhance both T and B cell responses to both the T-cell epitopes present in the T cell epitope polypeptide and in the E1/E2 polypeptides. Alternatively, the whole or part of the detoxified toxin ("toxoid") can be used, wherein specific amino acids of the toxins are mutated to render the toxins inactive, thereby generating toxoids. Methods of generating toxoids are well known in the art. Examples of bacterial epitopes include the use of diphtheria toxoid, meningococcal outer membrane protein, or mutant diphtheria protein CRM197 (see, e.g.: world-wide-website: Medscape.com/viewarticle/431127).

In some cases, a suitable tetanus toxoid polypeptide comprises the amino acid sequence QYIKANSKFIGIFE (SEQ ID NO:130). In some cases, a suitable tetanus toxoid polypeptide comprises the amino acid sequence QYIKANSKFIGITE (SEQ ID NO:131).

In some cases, a T cell epitope polypeptide can comprise cholera toxin (or toxoid) epitope. In some cases, a suitable T-cell epitope polypeptide comprising a cholera toxoid epitope comprises a fragment of cholera toxin-B subunit (CT-B), e.g., a fragment of from 5 amino acids to 25 amino acids, or from 25 amino acids to 50 amino acids, of the following amino acid sequence: MIKLKFGVFF TVLLSSAYAH GTPQNITDLC AEYHNTQIHT LNDKIFSYTE SLAGKREMAI ITFKNGATFQ VEVPGSQHID SQKKAIERMK DTLRIAYLTE AKVEKLCVWN NKTPHAIAAI SMAN (SEQ ID NO:132).

In some cases, a T cell epitope polypeptide can comprise a tetanus toxin (or toxoid) T-cell epitope. In some cases, a suitable T cell epitope polypeptide comprising a tetanus toxin T-cell epitope comprises the amino acid sequence: ILMQYIKANSKFIGI (SEQ ID NO:133); and has a length of from 15 amino acids to 20 amino acids. In some cases, a suitable T cell epitope polypeptide comprising a tetanus toxin T-cell epitope comprises the amino acid sequence: VNNESSE (SEQ ID NO:134). In some cases, a suitable T cell epitope polypeptide comprising a tetanus toxin T-cell epitope comprises the amino acid sequence: PGINGKAIHLVNNESSE (SEQ ID NO:135). In some cases, a suitable T cell epitope polypeptide comprising a tetanus toxin T-cell epitope comprises the amino acid sequence: PNRDIL (SEQ ID NO:136). In some cases, a suitable T cell epitope polypeptide comprising a tetanus toxin T-cell epitope comprises the amino acid sequence: FIGITEL (SEQ ID NO:137). In some cases, a suitable tetanus toxin T-cell epitope comprises the amino acid sequence: SYFPSV (SEQ ID NO:138). In some cases, a suitable T cell epitope polypeptide comprising a tetanus toxin T-cell epitope comprises the amino acid sequence: NSVDDALINSTKIYSYFPSV (SEQ ID NO:139). In some cases, a suitable T cell epitope polypeptide comprising a tetanus toxin T-cell epitope comprises the amino acid sequence: IDKISDVSTIVPYIGPALNI (SEQ ID NO:140).

In some cases, a T cell epitope polypeptide can comprise a diphtheria toxin T-cell epitope In some cases, a suitable T-cell epitope polypeptide comprising a diphtheria toxin T-cell epitope comprises the amino acid sequence: QSIALSSLMVAQAIP (SEQ ID NO:141); and has a length of from 15 amino acids to 20 amino acids. In some cases, a suitable T cell epitope polypeptide comprising a diphtheria toxin T-cell epitope comprises the amino acid sequence: PVFAGANYAAWAVNVAQVI (SEQ ID NO:142). In some cases, a suitable T cell epitope polypeptide comprising a diphtheria toxin T-cell epitope comprises the amino acid sequence: VHHNTEEIVAQSIALSSLMV (SEQ ID NO:143). In some cases, a suitable T cell epitope polypeptide comprising a diphtheria toxin T-cell epitope comprises the amino acid sequence: QSIALSSLMVAQAIPLVGEL (SEQ ID NO:144). In some cases, a suitable T cell epitope polypeptide comprising a diphtheria toxin T-cell epitope comprises the amino acid sequence: VDIGFAAYNFVESIINLFQV (SEQ ID NO:145). In some cases, a suitable T cell epitope polypeptide comprising a diphtheria toxin T-cell epitope comprises the amino acid sequence: QGESGHDIKITAENTPLPIA (SEQ ID NO:146). In some cases, a suitable T cell epitope polypeptide comprising a diphtheria toxin T-cell epitope comprises the amino acid sequence: GVLLPTIPGKLDVNKSKTHI (SEQ ID NO:147). In some cases, a suitable T cell epitope polypeptide comprising a diphtheria toxin T-cell epitope comprises the amino acid sequence of CRM197 (see, e.g., Giannini et al. (1984) *Nucl. Acids. Res.* 12:4063).

The amino acid sequence of CRM197 is as follows:

```
                                          (SEQ ID NO: 148)
laddvvdssksfvmenfssyhgtkpgyvdsiqkgiqkpksgtqgnydddw kefystdnkydaagysydnenplsgkaggvvkvtypgltkvlalkvdnae tikkelglsltepimeqvgteefikrfgdgasrvvlslpfaegsssveyi nnweqakalsveleinfetrgkrgqdamyeymaqacagnrvrrsygssls cinldwdvirdktktkieslkehgpiknkmsespnktvseekakqyleef
```

-continued
```
hqtalehpelselktvtgtnpvfaganyaawavnvaqvidsetadnlekt taalsilpgigsvmgiadgavhhnteeivaqsialsslmvaqaiplygel vdigfanynfvesiinlfqvvhnsynrpayspghktqpflhdgyayswnt vedsiirtgfqgesghdikitaentplpiagvllptipgkldvnksktthi svngrkirmrcraidgdvtfcrpkspvyvgngvhanlhvafhrsssekih sneissdsigvlgyqktvdhtkvnsklslffeiks.
```

In some cases, a T cell epitope polypeptide can comprise a tetanus toxin T-cell epitope and a diphtheria toxin T-cell epitope. In some of these cases, the T cell epitope polypeptide can comprise the amino acid sequence: IMQYIKANSKFIGIQSIALSSLMVAQ (SEQ ID NO:149); and can have a length of from 26 amino acids to 30 amino acids.

Mixtures of T-Cell Epitope Polypeptides (T-Cell Epitope Polypeptides)

In some cases, an immunogenic composition of the present disclosure comprises two or more different T-cell epitope polypeptides comprising a T-cell epitope present in an HCV protein other than E1 and E2 (e.g., a mixture of two or more different T-cell epitope polypeptides comprising a T-cell epitope present in an HCV protein other than E1 and E2).

For example, in some cases, an immunogenic composition of the present disclosure comprises: a) an HCV E1/E2 heterodimeric polypeptide; b) two or more different T-cell epitope polypeptides comprising a T-cell epitope present in an HCV protein other than E1 and E2; and c) a CDN. In some cases, an immunogenic composition of the present disclosure comprises: a) an HCV E2 polypeptide; b) two or more different T-cell epitope polypeptides comprising a T-cell epitope present in an HCV protein other than E1 and E2; and c) a CDNs.

For example, the two or more different T cell epitope polypeptides can include: i) a first T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids.

As another example, the two or more different T cell epitope polypeptides can include: i) a first T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids.

As another example, the two or more different T cell epitope polypeptides can include: i) a first T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 75 amino acids.

As another example, the two or more different T cell epitope polypeptides can include: i) a first T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100, and having a length of from 100 amino acids to 110 amino acids.

As another example, the two or more different T cell epitope polypeptides can include: i) a first T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171, and having a length of from 171 amino acids to 180 amino acids.

As another example, the two or more different T cell epitope polypeptides can include: i) a first T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228, and having a length of from 228 amino acids to 235 amino acids.

As another example, the two or more different T cell epitope polypeptides can include: i) a first T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553, and having a length of from 553 amino acids to 565 amino acids.

As another example, the two or more different T cell epitope polypeptides can include: i) a first T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second T cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778, and having a length of from 778 amino acids to 785 amino acids.

Pharmaceutically Acceptable Excipients

An immunogenic composition of the present disclosure can include a pharmaceutically acceptable excipient. A wide variety of pharmaceutically acceptable excipients is known in the art and need not be discussed in detail herein. Pharmaceutically acceptable excipients have been amply described in a variety of publications, including, for example, A. Gennaro (2000) "Remington: The Science and Practice of Pharmacy", 20th edition, Lippincott, Williams, & Wilkins; Pharmaceutical Dosage Forms and Drug Delivery Systems (1999) H. C. Ansel et al., eds 7th ed., Lippincott, Williams, & Wilkins; and Handbook of Pharmaceutical Excipients (2000) A. H. Kibbe et al., eds., 3rd ed. Amer. Pharmaceutical Assoc.

In some cases, a pharmaceutically acceptable excipient is an aqueous buffer. Thus, an immunogenic composition of the present disclosure can include an aqueous buffer. Suitable aqueous buffers include, but are not limited to, acetate, succinate, citrate, and phosphate buffers varying in strengths from about 5 mM to about 100 mM. In some cases, the aqueous buffer includes reagents that provide for an isotonic solution. Such reagents include, but are not limited to, sodium chloride; and sugars e.g., mannitol, dextrose, sucrose, and the like. In some embodiments, the aqueous buffer further includes a non-ionic surfactant such as polysorbate 20 (TWEEN®20) or polysorbate 80 (TWEEN®80). For example, an immunogenic composition of the present disclosure in an aqueous buffer can include, e.g., from about 0.01% to about 0.05% polysorbate-20 (TWEEN®20) non-ionic detergent. Optionally the formulations may further include a preservative. Suitable preservatives include, but are not limited to, a benzyl alcohol, phenol, chlorobutanol, benzalkonium chloride, and the like. In many cases, the formulation is stored at about 4° C. Formulations may also be lyophilized, in which case they generally include cryoprotectants such as sucrose, trehalose, lactose, maltose, mannitol, and the like. Lyophilized formulations can be stored over extended periods of time, even at ambient temperatures. In some cases, the aqueous buffer further includes a non-ionic surfactant. In some cases, the aqueous buffer includes the non-ionic surfactant Triton™ X-100, e.g., 0.1% Triton™ X-100.

Cyclic Dinucleotides

In some cases, a CDN suitable for use in an immunogenic composition of the present disclosure is of Formula (I):

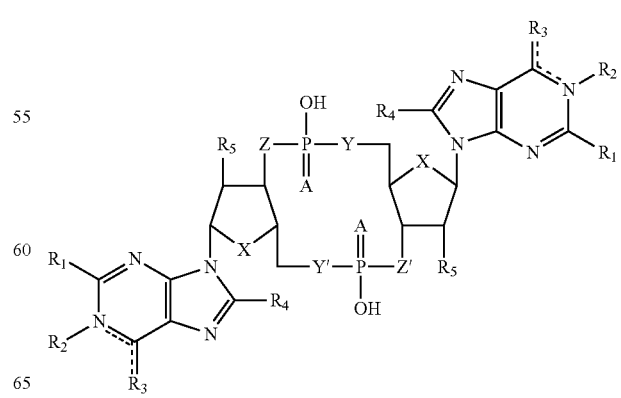

wherein:
A is S or O;
X is S, N, O, CH$_2$;
Y, Y' is NH, CH$_2$, O;
Z, Z' is NH, CH$_2$, O;
R1 represents hydrogen or NH$_2$ which may be substituted;
R2 is hydrogen or absent;
R3 represents NH$_2$, O, OH, H, or a halogen;
R4 represents hydrogen, halogen, or a straight or branched C$_1$-C$_6$ alkyl group which may optionally be substituted;
R5 represents hydrogen, OH or a straight or branched C$_1$-C$_6$ alkyl chain or C$_1$-C$_6$ straight or branched alkoxy chain which may optionally be substituted;
⚏ is a single or double bond;
or conjugates thereof, and salts or solvates thereof. See, e.g., US 2008/0286296.

In formula (I), the purine residue is in some cases a guanine (G), adenine (A), xanthine or hypoxanthine (X), or inosine (I) residue. The compound can have identical purine residues, e.g. c-diGMP, c-diAMP, c-diIMP, or c-dXMP, or can contain different purine residues, e.g. c-GpAp, c-GpIp, c-GpXp, c-ApIp, c-ApXp, or c-IpXp. Further, R5 is in some cases an OH group. In addition, X is in some cases an oxygen atom. In one embodiment, Y, Y', Z, and Z' are an oxygen atom, O. Thus, in one embodiment, the compound of formula (I) is a cyclic bis(3'-5')diguanylic acid (c-diGMP) or conjugates thereof or a cyclic bis(3'-5')diadenylic acid (c-diAMP) or conjugates thereof, or salts or solvates thereof. In one embodiment, the compound of formula (I) is cyclic Bis(3'-5')adenylic acid, which is also referred to as c-di-AMP; or the pegylated conjugate. With the term "which may be substituted" is meant the substitution with a straight or branched C1-C6 alkyl group or a straight or branched C1-C6 alkoxy group and/or with a halogen, hydroxyl group or carboxyl group.

In some cases, a CDN suitable for use in an immunogenic composition of the present disclosure is selected from the group consisting of cyclic di-adenosine monophosphate (c-di-AMP), cyclic di-guanosine monophosphate (c-di-GMP), and cyclic guanosine monophosphate-adenosine monophosphate (cGAMP). In some cases, a CDN suitable for use in an immunogenic composition of the present disclosure is cGAMP (2'-3'-cyclic GMP-AMP) or cGAMP (3'-3'-cyclic GMP-AMP). In some cases, a CDN suitable for use in an immunogenic composition of the present disclosure is cGAMP (2'-3'-cyclic GMP-AMP). In some cases, a CDN suitable for use in an immunogenic composition of the present disclosure is cGAMP (3'-3'-cyclic GMP-AMP).

In some cases, a CDN suitable for use in an immunogenic composition of the present disclosure is of Formula (II):

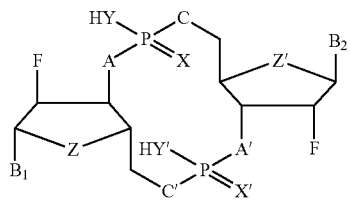

where:
A, C, A' and C' are independently selected from NH, O, and S;
X, Y, X', and Y' are independently selected from O or S;
Z and Z' are independently selected from O, S, NH, and CH$_2$; and
B$_1$ and B$_2$ are independently a purine selected from:

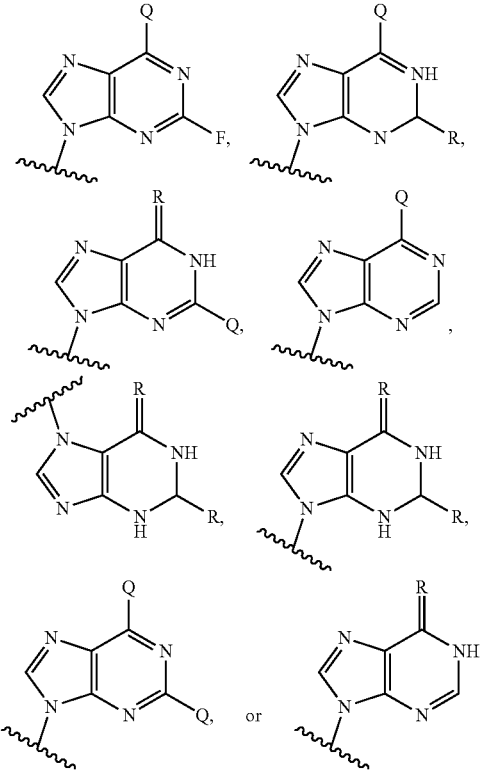

where:
Q is hydrogen or NH$_2$;
Nitrogen is optionally substituted with a C$_1$-C$_6$ alkyl or a C$_1$-C$_6$ acyl group; and
R is O or S.

In some cases, a CDN suitable for inclusion in an immunogenic composition of the present disclosure is a fluorinated CND. In some cases, the fluorinated CDN is 2'-F-c-diGMP having the following structure:

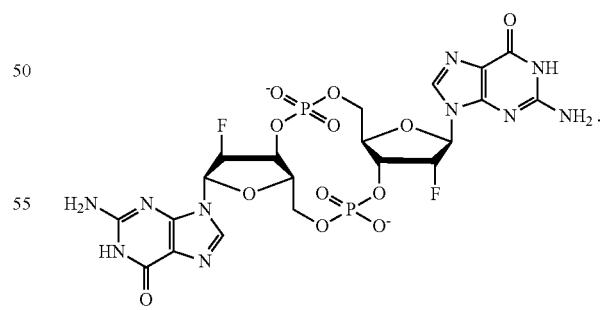

Immunogenic Composition Comprising HCV E1/E2, HCV E2, or HCV E1 and an Archaeal Glycolipid The present disclosure provides an immunogenic composition comprising: a) an HCV E1E2 heterodimer; and b) an archaeosome. The present disclosure provides an immunogenic composition comprising: a) an HCV E2 polypeptide; and b) an archaeosome. The present disclosure provides an immunogenic composition comprising: a) an HCV E1 polypeptide; and b) an archaeosome.

In some cases, an immunogenic composition of the present disclosure, when administered to an individual in need thereof, induces an immune response in the individual to one or more HCV genotypes. In some cases, an immunogenic composition of the present disclosure, when administered to an individual in need thereof, induces an immune response in the individual to one or more HCV genotypes, where the immune response is greater than the immune response induced by administration of a control composition comprising the HCV E1/E2 heterodimer (or E1 polypeptide, or E2 polypeptide) but lacking the archaeosome.

In some cases, an immunogenic composition of the present disclosure, when administered to an individual in need thereof, induces CD8$^+$ CTLs specific for HCV, where the number of HCV-specific CD8$^+$ CTLs induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific CD8$^+$ CTLs induced by administration of a control composition (e.g., a composition comprising the HCV E1/E2 heterodimer but lacking the archaeosome; a composition comprising an E1 polypeptide but lacking the archaeosome; a composition comprising an E2 polypeptide but lacking the archaeosome).

In some cases, an immunogenic composition of the present disclosure, when administered to an individual in need thereof, induces CD4$^+$ T cells specific for HCV, where the number of HCV-specific CD4$^+$ T cells induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific CD4$^+$ T cells induced by administration of a control composition (e.g., a composition comprising the HCV E1/E2 heterodimer but lacking the archaeosome; a composition comprising an E1 polypeptide but lacking the archaeosome; a composition comprising an E2 polypeptide but lacking the archaeosome).

In some cases, an immunogenic composition of the present disclosure, when administered to an individual in need thereof, induces production of HCV-specific CD4$^+$ T cells and CD8$^+$ T cells in the individual, where the number of HCV-specific CD4$^+$ T cells and/or CD8$^+$ T cells is increased, such that the percent of total peripheral CD4$^+$ and/or CD8$^+$ T cells that is HCV-specific is from 0.01% to 0.05%, from 0.05% to 0.10%, from 0.10% to 0.125%, from 0.125% to 0.25%, from 0.25% to from 0.50%, or 0.5% to 10% (e.g., from 0.5% to 1%, from 1% to 2%, from 2% to 5%, or from 5% to 10%). The number of HCV-specific CD4$^+$ T cells and CD8$^+$ T cells in a control individual (e.g., an individual not infected with HCV) not treated with the immunogenic composition would be undetectable.

In some cases, an immunogenic composition of the present disclosure, when administered to an individual in need thereof, increases the number of HCV E1/E2-specific CD4$^+$ T cells and CD8$^+$ T cells in the individual by at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, compared to the number of HCV E1/E2-specific CD4$^+$ T cells and CD8$^+$ T cells in the individual induced by administration of a control composition comprising the HCV E1/E2 heterodimer (or HCV E2 polypeptide, or HCV E1 polypeptide) but lacking the archaeosome, or compared to the number of HCV E1/E2-specific CD4$^+$ T cells and CD8$^+$ T cells in the individual before administration of the immunogenic composition.

In some cases, an immunogenic composition of the present disclosure, when administered to an individual in need thereof, induces helper T lymphocytes (e.g., CD4$^+$ T cells) specific for HCV, where the number of HCV-specific helper T lymphocytes induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific helper T cells induced by administration of a control composition comprising the HCV E1/E2 heterodimer (or HCV E2 polypeptide, or HCV E1 polypeptide) but lacking the archaeosome, or compared to the number of HCV-specific CD4$^+$ T cells in the individual before administration of the immunogenic composition.

In some cases, an immunogenic composition of the present disclosure, when administered to an individual in need thereof, induces antibody specific for HCV, where the level of HCV-specific antibody induced is at least at high as the level of HCV-specific antibody induced by administration of a control composition comprising the HCV E1/E2 heterodimer (or HCV E2 polypeptide, or HCV E1 polypeptide) but lacking the archaeosome.

In some cases, an immunogenic composition of the present disclosure, when administered to an individual in need thereof, induces antibody specific for HCV, where the level of HCV-specific antibody induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the level of HCV-specific antibody induced by administration of a control composition comprising the HCV E1/E2 heterodimer (or HCV E2 polypeptide, or HCV E1 polypeptide) but lacking the archaeosome, or compared the level of HCV-specific antibody in the individual before administration of the immunogenic composition.

An immunogenic composition of the present disclosure, when administered to an individual in need thereof, induces an immune response (e.g., a cellular immune response) in the individual to one or more HCV genotypes. In some cases, an immunogenic composition of the present disclosure, when administered to an individual in need thereof, induces an immune response in the individual to HCV genotype 1. In some cases, an immunogenic composition of the present disclosure, when administered to an individual in need thereof, induces an immune response in the individual to HCV genotype 2. In some cases, an immunogenic composition of the present disclosure when administered to an individual in need thereof, induces an immune response in the individual to HCV genotype 3. In some cases, an immunogenic composition of the present disclosure, when administered to an individual in need thereof, induces an immune response in the individual to HCV genotype 1 and HCV genotype 3. In some cases, an immunogenic composition of the present disclosure, when administered to an individual in need thereof, induces an immune response in the individual to HCV genotype 1, HCV genotype 2, and HCV genotype 3. In some cases, an immunogenic composition of the present disclosure, when administered to an individual in need thereof, induces an immune response in the individual to HCV genotype 1, HCV genotype 2, HCV genotype 3, and HCV genotype 7. In some cases, an immunogenic composition of the present disclosure, when administered to an individual in need thereof, induces an immune response in the individual to HCV genotype 1, HCV genotype 2, HCV genotype 3, HCB genotype 4, HCV genotype 5, HCV genotype 6, and HCV genotype 7.

HCV E1E2 Heterodimers, HCV E2 Polypeptides, and HCV E1 Polypeptides.

The present disclosure provides an immunogenic composition comprising: a) an HCV E1E2 heterodimer; and b) an archaeosome. The present disclosure provides an immunogenic composition comprising: a) an HCV E2 polypeptide; and b) an archaeosome. The present disclosure provides an immunogenic composition comprising: a) an HCV E1 polypeptide; and b) an archaeosome. Suitable HCV E1E2 heterodimers, HCV E2 polypeptides, and HCV E1 polypeptides are as described above.

Archaeal Lipids and Archaeosomes

An archaeal lipid suitable for use in an immunogenic composition of the present disclosure comprises a polar lipid based on a 2, 3-dialkylglycerol skeleton. These 2, 3-dialkylglycerol groups are isoprenoid and the simplest molecules are derivatives or 2,3-dibiphytanyl-O-sn-glycerol (archeol); for instance, two isoprenoid units of 20 carbons joined at positions sn-2 and sn-3 of glycerol. These alkyl chains are generally saturated; nevertheless, some forms have double bonds in different positions. These lipids have one or two groups of polar head, which may be different with units 2, 3-sn-glycerol joined by C40 alkyl components which are also isoprenoid molecules. For instance, calarcheol (so called because it is the predominant form in some thermophile archaebacteria), has two C40 isoprenoid units bonded from positions 2 to 3' and from position 3 to 2'.

In some cases, an archaeal adjuvant suitable for use in an immunogenic composition of the present disclosure comprises multivalent cations in association with aggregates of a plurality of spherical archaeal polar lipid structures containing aqueous compartments (e.g., an "AMVAD structure"), where the archaeal polar lipid is a total polar lipids extract or archaetidyl glycerophosphate-O-methyl, obtained from an archaeal species. The multivalent cations can be divalent or trivalent cations. The multivalent cations can be divalent $Ca^{2+}$ or $Mg^{2+}$, or trivalent $Al^{3+}$. The $Ca^{2+}$ can be provided as $CaCl_2$. The $Al^{3+}$ can be provided as $AlCl_3$ or $AlK(SO_4)_2$. In some cases, the total polar lipids extract from an archaeal species is mixed with neutral lipids from the archaeal species. See, e.g., U.S. Patent Publication No. 2013/0195932.

In some cases, lipids suitable for use in an immunogenic composition of the present disclosure comprises 1,2-di-O-hexadecyl-sn-glycero-3-phosphatidylcholine and 1,2-di-O-phytanyl-sn-glycero-3-phosphatidylethanolamine. In some cases, the 1,2-di-O-hexadecyl-sn-glycero-3-phosphatidylcholine and 1,2-di-O-phytanyl-sn-glycero-3-phosphatidylethanolamine form uniformly sized particles; for example, the particles can comprise: liposomes, nanoliposomes, niosomes, microspheres, nanospheres, nanoparticles, micelles or archaeosomes.

In some cases, an archaeosome comprises at least one polar synthetic lipid, where the at least one polar synthetic lipid comprises at least one carbohydrate or anionic group linked by covalent bonding to at least one free hydroxyl group of an archaeal core lipid. In some cases, the archaeal core lipid is archaeol (2,3-di-O-diphytanyl-sn-glycerol). In some cases, the archaeal core lipid is caldarchaeol (2,2',3,3'-tetra-O-dibiphytanyl-sn-diglycerol). In some cases, the carbohydrate group is selected from the group consisting of: β-D-Glc-(1,6)-β-D-Glc-; β-D-Glc-(1,6)-α-D-Glc-; α-D-Glc-(1,6)-β-D-Glc-; β-D-Glc-(1,4)-β-D-Glc-; α-D-Glc-(1,4)-β-D-Glc-; β-D-Gal-(1,4)-β-D-Glc-; α-D-Gal-(1,6)-β-D-Glc-; β-D-Glc-(1,6)-β-D-Glc-(1,6)-β-D-Glc-; α-D-Glc-(1,4)-α-D-Glc-(1,4)-β-D-Glc-; α-D-Man-(1,2)-α-D-Man-(1,2)-α-D-Man-; and α-D-Man-(1,2)-α-D-Man-(1,2)-α-D-Man-(1,2)-α-D-Man-. In some cases, the carbohydrate group comprises two or three β-D-Glc-units in (1,6) linkage. In some cases, the carbohydrate group is a Galactose-Glucose (gal-glc) group. In some cases, the anionic group is selected from the group consisting of phosphoserine, phosphoethanolamine, phosphoinositol and phosphoglycerol. In some cases, the at least one anionic lipid is selected from the group consisting of archaetidylglycerol, archaetidylglycerolphosphate-methyl, archaetidylserine, and archaetidylinositol. In some cases, the archaeosome comprises at least one conventional lipid. In some cases, the at least one conventional lipid is selected from a group consisting of phosphatidylglycerol, phosphatidylserine, sulfoquinovosyl diacylglycerol (SQDG), and cholesterol. In some cases, the at least one conventional lipid comprises cholesterol, and wherein cholesterol is present in an amount of between 10 and 45 mol % of the total lipid composition. In some cases, the phosphatidylglycerol is present in an amount of between 20 and 80 mol % of the lipid composition. In some cases, the phosphatidylserine is present in an amount of between 10 and 30 mol % of the lipid composition. In some cases, the at least one polar synthetic lipid comprises at least one synthetic immunoactive glycolipid and at least one anionic lipid, and the archaeosome further comprises at least one stabilizing lipid. In some cases, the at least one polar synthetic lipid comprises caldarchaeol having one carbohydrate head group and one anionic head group. In some cases, the carbohydrate head group comprises gentiobiose and the anionic head group comprises phosphoinositol. In some cases, the at least one polar synthetic lipid comprises a first caldarchaeol having two carbohydrate head groups and a second caldarchaeol having two anionic head groups, and wherein the at least one stabilizing lipid is the first and/or second caldarchaeol. In some cases, the at least one polar synthetic lipid comprises gentiotriose-archaeol and wherein the at least one stabilizing lipid comprises cholesterol and at least one of phosphatidylethanolamine, archaetidylglycerol, archaetidylserine or archaetidylglycerolphosphate-methyl.

Caldarchaeol is also known as dibiphytanyldiglycerol tetraether. Two glycerol units are linked together by two strains that consist of two phytanes linked together to form a linear chain of 32 carbon atoms. Caldarchaeol has the following structure:

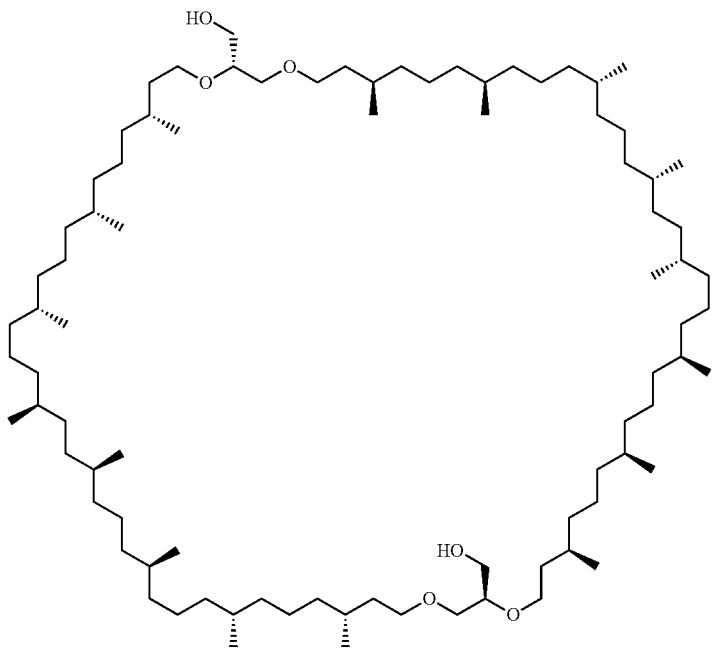

Archaeal lipids can be obtained from any archaea of the phyla Euryarchaeota, Crenarchaeota, Korarchaeota, or, Nanoarchaea. Archaeal lipids can be obtained from any archaea of the genus *Thermococcus, Sulfolobus, Halobacterium, Methanococcus, Ferroglobus, Thermoplasma, Archaeoglobus, Haloquadratum*, or *Halorubrum*. Suitable sources of archaeal lipids include, but are not limited to, *Thermus aquaticus, Thermus thermophilus; Methanobrevibacter smithii; Thermoplasma acidophilum*; a *Sulfolobus* species, e.g. *Sulfolobus acidocaldarius, Sulfolobus solfataricus, Sulfolobus islandicus, Sulfolobus tokodaii*, etc.; a *Pyrobaculum* species, e.g. *Pyrobaculum islandicum* or *Pyrobaculum aerophilum*; a *Methanococcus* species, e.g., *Methanocaldococcus vulcanius, Methanocaldococcus jannaschii, Methanococcus acolicus, Methanococcus voltae*; or a *Halobacterium* species such as *Halobacterium salinarum; Methanopyrus kandleri; Methanobacterium espanolae; Methanosphaera stadtmanae; Methanosarcina mazei; Natronobacterium magadii*; etc.

Total polar lipids (TPL) can be extracted from archaea and collected as the acetone-insoluble fraction. Choquet et al. (1994) *Appl. Microbiol. Biotechnol.* 42:375; Bligh and Dyer (1959) *Can. J. Biochem. Physiol.* 37:911. The polar lipids consist of regularly branched, and usually fully saturated, phytanyl chains of 20, 25, or 40 carbon length, with the 20 and 40 being most common. Archaeosomes can be prepared by hydrating TPL in a buffer (e.g., phosphate-buffered saline). The TPL-buffer solution can be sonicated (e.g., at 60 Hz for 10 min).

TPL can be extracted from archaea by stirring the cells (which may be lyophilized) with chloroform-methanol (2:1, v/v) for 1 hour at room temperature. The suspension is passed through a sintered glass filter, and the residue reextracted for an additional hour. Combined filtrates are evaporated, taken up in chloroform-methanol-water (60:30:4.5, v/v/v), and passed through Sephadex G-25 for removal of nonlipid contaminations. Langworthy et al. (1977) *J. Bacteriol.* 130:1326.

The mean diameter of archaeosomes in an archaeosomal formulation can range from about 50 nm to 600 nm, e.g., from 50 nm to 100 nm, from 100 nm to 150 nm, from 150 nm to 200 nm, from 200 nm to 250 nm, from 250 nm to 300 nm, from 300 nm to 400 nm, from 400 nm to 450 nm, from 450 nm to 500 nm, from 500 nm to 550 nm, or from 550 nm to 600 nm.

T-Cell Epitope Polypeptides

In some cases, one or both of the polypeptide chains of the E1/E2 heterodimer present in an immunogenic composition of the present disclosure can include a T-cell epitope polypeptide. In some cases, an E2 polypeptide present in an E1/E2 heterodimer present in an immunogenic composition of the present disclosure includes a T-cell epitope polypeptide. In some cases, an E1 polypeptide present in an E1/E2 heterodimer present in an immunogenic composition of the present disclosure includes a T-cell epitope polypeptide. In some cases, an HCV E2 polypeptide present in an immunogenic composition of the present disclosure includes a T-cell epitope polypeptide. In some cases, an HCV E1 polypeptide present in an immunogenic composition of the present disclosure includes a T-cell epitope polypeptide. In these embodiments, the T-cell epitope is covalently linked to the E1 and/or E2 polypeptide. For example, in some cases, the T-cell epitope is covalently linked to the amino terminus (N-terminus) of the HCV E1 polypeptide. In some cases, the T-cell epitope is covalently linked to the carboxyl terminus (C-terminus) of the HCV E1 polypeptide. Thus, e.g., in some cases, an immunogenic composition of the present disclosure comprises: a) a fusion polypeptide comprising, in order from N-terminus to C-terminus: i) an HCV E1 polypeptide; and ii) a T-cell epitope polypeptide; and b) an archaeosome. In some cases, an immunogenic composition of the present disclosure comprises: a) a fusion polypeptide comprising, in order from N-terminus to C-terminus: i) an HCV E2 polypeptide; and ii) a T-cell epitope polypeptide; and b) an archaeosome. In some cases, an immunogenic composition of the present disclosure comprises: a) a fusion polypeptide comprising, in order from N-terminus to C-terminus: i) a T-cell epitope polypeptide; and ii) an HCV E1 polypeptide; and b) an archaeosome. In some cases, an immunogenic composition of the present disclosure comprises: a) a fusion polypeptide comprising, in order from N-terminus to C-terminus: i) a T-cell epitope polypeptide; and ii) an HCV E2 polypeptide; and b) an archaeosome. In some cases, an immunogenic composition of the present disclosure comprises: a) an HCV E1E2 heterodimer comprising i) a fusion polypeptide comprising, in order from N-terminus to C-terminus: an HCV E1 polypeptide; and a T-cell epitope polypeptide; and ii) an HCV E2 polypeptide; and b) an archaeosome. In some cases, an immunogenic composition of the present disclosure comprises: a) an HCV E1E2 heterodimer comprising i) a fusion polypeptide comprising, in order from N-terminus to C-terminus: an HCV E2 polypeptide; and a T-cell epitope polypeptide; and ii) an HCV E2 polypeptide; and b) an archaeosome. In some cases, an immunogenic composition of the present disclosure comprises: a) an HCV E1E2 heterodimer comprising i) a fusion polypeptide comprising, in order from N-terminus to C-terminus: a T-cell epitope polypeptide; and an HCV E1 polypeptide; and ii) an HCV E2 polypeptide; and b) an archaeosome. In some cases, an immunogenic composition of the present disclosure comprises: a) an HCV E1E2 heterodimer comprising i) a fusion polypeptide comprising, in order from N-terminus to C-terminus: a T-cell epitope polypeptide; and an HCV E2 polypeptide; and ii) an HCV E1 polypeptide; and b) an archaeosome.

In some cases, an immunogenic composition of the present disclosure comprises a T-cell epitope polypeptide, where the T-cell epitope polypeptide is not covalently linked to the HCV E1/E2 heterodimer, the HCV E1 polypeptide or the HCV E2 polypeptide. For example, in some cases, an immunogenic composition of the present disclosure comprises: a) an HCV E1/E2 heterodimer; b) an archaeosome; and c) a T-cell epitope polypeptide. In some cases, an immunogenic composition of the present disclosure comprises: a) an HCV E2 polypeptide; b) an archaeosome; and c) a T-cell epitope polypeptide. In some cases, an immunogenic composition of the present disclosure comprises: a) an HCV E1 polypeptide; b) an archaeosome; and c) a T-cell epitope polypeptide.

Suitable T-cell epitope polypeptides are as described above.

Compositions Comprising a T-Cell Epitope Polypeptide Comprising T-Cell Epitopes Present in an HCV Polypeptide Other than E1 and E2

The present disclosure provides an immunogenic composition comprising: a) a T-cell epitope polypeptide comprising T-cell epitopes present in an HCV polypeptide other than E1 and E2; and b) a CDN. The present disclosure provides an immunogenic composition comprising: a) a T-cell epitope polypeptide comprising T-cell epitopes present in an HCV polypeptide other than E1 and E2; and b) an archaeosome.

Suitable T-cell epitope polypeptides are as described above. Suitable CDNs are as described above. Suitable archaeosomes are as described above.

Nucleic Acid Immunogenic Compositions

The present disclosure provides nucleic acid compositions comprising: a) one or more nucleic acids comprising a nucleotide sequence(s) encoding polypeptides (e.g., HCV E1/E2; HCV E1; HCV E2; T-cell epitope polypeptide) as described above; and b) a CDN. The present disclosure provides nucleic acid compositions comprising: a) one or more nucleic acids comprising a nucleotide sequence(s) encoding polypeptides (e.g., HCV E1/E2; HCV E1; HCV E2; T-cell epitope polypeptide) as described above; and b) an archaeosome. The present disclosure provides an immunogenic composition comprising: a) a nucleic acid (e.g., a recombinant viral expression vector(s)) comprising nucleotide sequence(s) encoding one or more of: an HCV E1/E2 heterodimer; an HCV E1 polypeptide; an HCV E2 polypeptide; and a T-cell epitope polypeptide, where such polypeptides are described above; and b) a CDN. The present disclosure provides an immunogenic composition comprising: a) a nucleic acid (e.g., a recombinant viral expression vector(s)) comprising nucleotide sequence(s) encoding one or more of: an HCV E1/E2 heterodimer; an HCV E1 polypeptide; an HCV E2 polypeptide; and a T-cell epitope polypeptide, where such polypeptides are described above; and b) an archaeosome. The polypeptides can be encoded in the same nucleic acid, or on separate nucleic acids. For example, where the nucleic acid(s) are recombinant expression vectors, the polypeptides can be encoded in the same or separate recombinant expression vectors.

In some cases, the nucleic acid(s) is/are DNA. In some cases, the nucleic acid(s) is/are RNA. In some cases, the nucleic acid(s) is/are present in expression vector(s), generating recombinant expression vector(s) comprising the nucleic acid(s). In some cases, the recombinant expression vector(s) is/are recombinant bacterial vectors. In some cases, the recombinant expression vector(s) is/are recombinant viral vector(s). In some cases, the recombinant viral vector(s) are packaged into viral particles. In some cases, the nucleic acid(s) are present in bacteria (e.g., non-pathogenic bacteria (e.g., attenuated bacteria) suitable for delivery of nucleic acids to an individual). Where the recombinant expression vector is a bacterial vector or a viral vector, the vector is suitably attenuated so as not to cause significant pathology in an individual.

In some cases, the nucleic acid is present in an expression vector. Suitable expression vectors include, but are not limited to, a replication-defective adenovirus vector; a replication-defective vaccinia virus vector; a lentivirus vector (e.g., a self-inactivating lentivirus vector); a retroviral vector (e.g., a self-inactivating retroviral vector); an adeno-associated virus vector; and the like. In some cases, the vector is a modified vaccinia Ankara (MVA) vector, or an MVA-based vector (see, e.g., Verheust et al. (2012) *Vaccine* 30:2623). In some cases, the vector is a replication-defective adenovirus vector. In some cases, the vector is a replication-defective adenovirus 6 (Ad6) vector. In some cases, the vector is a replication-defective simian adenovirus vector (e.g., ChAd3). Suitable viral vectors are described in, e.g., Zhou et al. (2012) *Invest. Ophthalmol. Vis. Sci.* 53:2804; Swadling et al. (2014) *Sci. Transl. Med.* 6:261ra153; and Choi and Chang (2013) *Clin. Exp. Vaccine Res.* 2:97. In many cases, the recombinant viral vectors are packaged into viral particles; and the viral particles are formulated in an immunogenic composition along with a pharmaceutically acceptable carrier. Suitable pharmaceutically acceptable carriers are described above.

In some cases, an immunogenic composition of the present disclosure comprises: a) a recombinant viral vector comprising nucleotide sequences encoding one or more of: an HCV E1/E2 heterodimer; an HCV E1 polypeptide; an HCV E2 polypeptide; and a T-cell epitope polypeptide; and b) a CDN or an archaeosome. In some cases, an immunogenic composition of the present disclosure comprises: a) a recombinant viral vector comprising nucleotide sequences encoding: an HCV E1/E2 heterodimer; and a T-cell epitope polypeptide; and b) a CDN or an archaeosome. In some cases, an immunogenic composition of the present disclosure comprises: a) a recombinant viral vector comprising nucleotide sequences encoding: an HCV E1 polypeptide; and a T-cell epitope polypeptide; and b) a CDN or an archaeosome. In some cases, an immunogenic composition of the present disclosure comprises: a) a recombinant viral vector comprising nucleotide sequences encoding: an HCV E2 polypeptide; and a T-cell epitope polypeptide; and b) a CDN or an archaeosome. In some cases, an immunogenic composition of the present disclosure comprises: a) a recombinant viral vector comprising nucleotide sequences encoding an HCV E1/E2 heterodimer; and b) a CDN or an archaeosome. In some cases, an immunogenic composition of the present disclosure comprises: a) a recombinant viral vector comprising nucleotide sequences encoding an HCV E2 polypeptide; and b) a CDN or an archaeosome. In some cases, an immunogenic composition of the present disclosure comprises: a) a recombinant viral vector comprising nucleotide sequences encoding an HCV E1 polypeptide; and b) a CDN or an archaeosome.

In some cases, the present disclosure provides: a) a first immunogenic composition comprising: i) a recombinant viral vector comprising nucleotide sequences encoding one or more of: an HCV E1/E2 heterodimer; an HCV E1 polypeptide; an HCV E2 polypeptide; and a T-cell epitope polypeptide; and ii) a CDN; and b) a second immunogenic composition comprising: i) a recombinant viral vector comprising nucleotide sequences encoding one or more of: an HCV E1/E2 heterodimer; an HCV E1 polypeptide; an HCV E2 polypeptide; and a T-cell epitope polypeptide; and ii) a CDN. In some cases, the present disclosure provides: a) a first immunogenic composition comprising: i) a recombinant viral vector comprising nucleotide sequences encoding one or more of: an HCV E1/E2 heterodimer; an HCV E1 polypeptide; an HCV E2 polypeptide; and a T-cell epitope polypeptide; and ii) an archaeosome; and b) a second immunogenic composition comprising: i) a recombinant viral vector comprising nucleotide sequences encoding one or more of: an HCV E1/E2 heterodimer; an HCV E1 polypeptide; an HCV E2 polypeptide; and a T-cell epitope polypeptide; and ii) an archaeosome.

In some cases, the present disclosure provides: a) a first immunogenic composition comprising: i) a first recombinant viral vector comprising nucleotide sequences encoding one or more of: an HCV E1/E2 heterodimer; an HCV E1 polypeptide; an HCV E2 polypeptide; and a T-cell epitope polypeptide; and ii) a CDN or an archaeosome; and b) a second immunogenic composition comprising: i) a second recombinant viral vector comprising nucleotide sequences encoding one or more of: an HCV E1/E2 heterodimer; an HCV E1 polypeptide; an HCV E2 polypeptide; and a T-cell epitope polypeptide; and ii) a CDN or an archaeosome. In some cases, the first recombinant viral vector is a replication-defective adenovirus-based recombinant viral vector; and the second recombinant viral vector is an MVA-based recombinant viral vector. In some cases, the first recombinant viral vector is a chimpanzee adenovirus-based recombinant viral vector; and the second recombinant viral vector is an MVA-based recombinant viral vector.

In some cases, the nucleic acid(s) are present in bacteria (e.g., non-pathogenic bacteria suitable for delivery of nucleic acids to an individual). In some cases, the nucleic acid(s) are present in recombinant expression vector(s) present in bacteria (e.g., non-pathogenic bacteria suitable for delivery of nucleic acids to an individual). Thus, the present disclosure provides an immunogenic composition comprising a non-pathogenic bacterium that harbors a nucleic acid(s) comprising nucleotide sequences encoding one or more of: an HCV E1/E2 heterodimer; an HCV E1 polypeptide; an HCV E2 polypeptide; and a T-cell epitope polypeptide, where such polypeptides are described above. The present disclosure provides an immunogenic composition comprising a non-pathogenic bacterium that harbors a recombinant expression vector(s) comprising nucleotide sequences encoding one or more of: an HCV E1/E2 heterodimer; an HCV E1 polypeptide; an HCV E2 polypeptide; and a T-cell epitope polypeptide, where such polypeptides are described above. In some cases, the bacteria are live. In some cases, the bacteria are live attenuated bacteria. In some cases, the bacteria are killed.

Bacteria suitable for delivery of nucleic acid(s) (which nucleic acid(s) may be present in expression vector(s)) include, but are not limited to, *Lactobacillus; Lactococcus* (e.g., *Lactococcus lactis*); *Salmonella*, e.g., attenuated, non-pathogenic *Salmonella*, e.g., *Salmonella enterica* serovar *typhi, Salmonella enterica* serovar *typhimurium*; non-pathogenic strains of *Francisella*; non-pathogenic strains of *Escherichia coli*; non-pathogenic strains of *Bordetella pertussis*; non-pathogenic strains of *Listeria*; non-pathogenic strains of *Shigella*; non-pathogenic strains of *Vibrio* (e.g., *Vibrio cholera*); *Streptococcus gordonii*; non-pathogenic strains of *Yersinia enterocolitica*; non-pathogenic strains of *Shigella flexneri*; non-pathogenic strains of *Pseudomonas aeruginosa*; non-pathogenic strains of *Bacillus subtilis*; and the like.

In some cases, one or more virulence genes in the bacterium is all or partially deleted. For example, for *Salmonella enterica* serovar *typhi* and *Salmonella enterica* serovar *typhimurium*, an aroA, aroC, and aroD mutation can be made. Other mutations that can attenuate pathogenicity affect biosynthesis of the nucleotides adenine (pur) and guanine (guaBA), and outer membrane proteins C and F (ompC, ompF), as well as expression of the cAMP receptor (cyal crp), the conversion of UDP-galactose to UDP-glucose (galE), DNA recombination and repair (recA, recBC), and regulation of virulence genes (phoP, phoQ). For *Listeria monocytogenes*, attenuation can be achieved with auxotrophic mutants, or deletion of virulence factors such as the genes actA and internalin B (intB).

Methods of Inducing an Immune Response to HCV

The present disclosure provides a method of inducing an immune response (e.g., a protective immune response) to at least one HCV genotype in a mammalian subject (e.g., a human). In some cases, a method of the present disclosure for inducing an immune response in an individual to at least one HCV genotype comprises administering an immunogenic composition of the present disclosure, where the immunogenic composition comprises polypeptides (e.g., HCV E1/E2, HCV E1, or HCV E2; and optionally a T-cell epitope polypeptide). In some cases, a method of the present disclosure for inducing an immune response in an individual to at least one HCV genotype comprises administering an immunogenic composition of the present disclosure, where the immunogenic composition comprises one or more nucleic acids comprising nucleotide sequences encoding polypeptides (e.g., e.g., HCV E1/E2, HCV E1, or HCV E2; and optionally a T-cell epitope polypeptide).

Administering an Immunogenic Composition Comprising Polypeptides

In some cases, the methods comprise administering to an individual in need thereof an effective amount of an immunogenic composition of the present disclosure, where the immunogenic composition comprises: a) an HCV E1/E2 heterodimer; and b) a CDN; or where the immunogenic composition comprises: a) an HCV E2 polypeptide; and b) a CDN; or where the immunogenic composition comprises:

a) an HCV E1 polypeptide; and b) a CDN. In some cases, the methods comprise administering to an individual in need thereof an effective amount of an immunogenic composition of the present disclosure, where the immunogenic composition comprises: a) an HCV E1/E2 heterodimer; and b) an archaeosome; or where the immunogenic composition comprises: a) an HCV E2 polypeptide; and b) an archaeosome; or where the immunogenic composition comprises: a) an HCV E1 polypeptide; and b) an archaeosome.

In some cases, the methods comprise administering to an individual in need thereof an effective amount of an immunogenic composition of the present disclosure, where the immunogenic composition comprises: a) an HCV E1/E2 heterodimer; b) a T-cell epitope polypeptide comprising a T-cell epitope present in an HCV polypeptide other than E1 and E2; and c) a CDN; or where the immunogenic composition comprises: a) an HCV E2 polypeptide; b) a T-cell epitope polypeptide comprising a T-cell epitope present in an HCV polypeptide other than E1 and E2; and c) a CDN; or where the immunogenic composition comprises: a) an HCV E1 polypeptide; b) a T-cell epitope polypeptide comprising a T-cell epitope present in an HCV polypeptide other than E1 and E2; and c) a CDN.

In some cases, the methods comprise administering to an individual in need thereof an effective amount of an immunogenic composition of the present disclosure, where the immunogenic composition comprises: a) an HCV E1/E2 heterodimer; b) a T-cell epitope polypeptide comprising a T-cell epitope present in an HCV polypeptide other than E1 and E2; and c) an archaeosome; or where the immunogenic composition comprises: a) an HCV E2 polypeptide; b) a T-cell epitope polypeptide comprising a T-cell epitope present in an HCV polypeptide other than E1 and E2; and c) an archaeosome; or where the immunogenic composition comprises: a) an HCV E1 polypeptide; b) a T-cell epitope polypeptide comprising a T-cell epitope present in an HCV polypeptide other than E1 and E2; and c) an archaeosome.

In some cases, an immunogenic composition of the present disclosure comprising an HCV E1/E2 heterodimer and a CDN is administered via intramuscular administration. In some cases, an immunogenic composition of the present disclosure comprising an HCV E1/E2 heterodimer and a CDN is administered via intranasal administration. In some cases, an immunogenic composition of the present disclosure comprising an HCV E1/E2 heterodimer and a CDN is administered: a) first via intramuscular administration; b) followed by a second administration via intranasal administration; c) followed by a third administration via intranasal administration.

In some cases, an immunogenic composition of the present disclosure comprising an HCV E1/E2 heterodimer and an archaeosome is administered via intramuscular administration.

Administering an Immunogenic Composition Comprising Nucleic Acid(s)

In some cases, a method of the present disclosure for inducing an immune response to HCV in an individual comprises administering to the individual an effective amount of an immunogenic composition comprising: a) nucleic acid(s) comprising nucleotide sequences encoding: 1) an HCV E1/E2 heterodimer and a T-cell epitope polypeptide; 2) an HCV E2 polypeptide and a T-cell epitope polypeptide; 3) an HCV E1 polypeptide and a T-cell epitope polypeptide; 4) an HCV E1/E2 heterodimer; 5) an HCV E2 polypeptide; or 6) an HCV E1 polypeptide; and b) a CDN or an archaeosome. The polypeptides can be encoded in the same nucleic acid, or on separate nucleic acids. For example, where the nucleic acid(s) are recombinant expression vectors, the polypeptides can be encoded in the same or separate recombinant expression vectors.

In some cases, the nucleic acid(s) is/are DNA. In some cases, the nucleic acid(s) is/are RNA. In some cases, the nucleic acid(s) is/are present in expression vector(s) such that a recombinant expression vector(s) comprising the nucleic acid(s) are administered. In some cases, the recombinant expression vector(s) is/are recombinant viral vector(s). In some cases, the recombinant viral vector(s) are packaged into viral particles. In some cases, the nucleic acid(s) are present in bacteria (e.g., non-pathogenic bacteria (e.g., attenuated bacteria) suitable for delivery of nucleic acids to an individual).

In some cases, the nucleic acid is present in an expression vector, thereby generating a recombinant expression vector. Suitable expression vectors include, but are not limited to, a replication-defective adenovirus vector; a replication-defective vaccinia virus vector; a lentivirus vector (e.g., a self-inactivating lentivirus vector); a retroviral vector (e.g., a self-inactivating retroviral vector); an adeno-associated virus vector; and the like. In some cases, the vector is a modified vaccinia Ankara (MVA) vector, or an MVA-based vector (see, e.g., Verheust et al. (2012) *Vaccine* 30:2623). In some cases, the vector is a replication-defective adenovirus vector. In some cases, the vector is a replication-defective adenovirus 6 (Ad6) vector. In some cases, the vector is a replication-defective simian adenovirus vector (e.g., ChAd3). Suitable viral vectors are described in, e.g., Zhou et al. (2012) *Invest. Ophthalmol. Vis. Sci.* 53:2804; Swadling et al. (2014) *Sci. Transl. Med.* 6:261ra153; and Choi and Chang (2013) *Clin. Exp. Vaccine Res.* 2:97. In many cases, the recombinant viral vectors are packaged into viral particles; and the viral particles are formulated in an immunogenic composition along with a pharmaceutically acceptable carrier.

In some cases, an HCV E1/E2 heterodimer is encoded by nucleotide sequences present in a first recombinant viral vector, e.g., an adenovirus vector, a vaccinia virus vector, an MVA vector or MVA-based vector; and a T-cell epitope polypeptide is encoded by nucleotide sequences present in a second recombinant viral vector, e.g., an adenovirus vector, a vaccinia virus vector, an MVA vector or MVA-based vector.

In some cases, a prime-boost vaccine protocol is used. In some cases, a first (priming) immunogenic composition is administered, where the first immunogenic composition comprises a recombinant viral vector comprising nucleotide sequences encoding one or more of: a) an HCV E1/E2 heterodimer; b) an HCV E2 polypeptide; c) an HCV E1 polypeptide; and d) a T-cell epitope polypeptide; and, after a time, a second (booster) immunogenic composition is administered, where the second immunogenic composition comprises a recombinant viral vector comprising nucleotide sequences encoding one or more of: a) an HCV E1/E2 heterodimer; b) an HCV E2 polypeptide; c) an HCV E1 polypeptide; and d) a T-cell epitope polypeptide. In some cases, the first recombinant viral vector and the second recombinant viral vector are the same. In some cases, the first recombinant viral vector and the second recombinant viral vector are different. For example, in some cases, the first recombinant viral vector is a vaccinia-based recombinant viral vector; and the second recombinant viral vector is an adenovirus-based recombinant viral vector. In general, the recombinant viral vectors are packaged into viral particles. A second immunogenic composition can be administered at a time period of from 1 day to 1 year following administration of the first immunogenic composition. For example, a second immunogenic composition can be administered at a time period of from 1 day to 1 week, from 1 week to 2 weeks, from 2 weeks to 1 month, from 1 month to 2 months, from 2 months to 6 months, or from 6 months to 1 year following administration of the first immunogenic composition.

For example, in some cases, a first (priming) vaccine comprising a recombinant adenovirus (e.g., Ad6 or chimpanzee Ad (e.g., ChAd3)) that comprises a nucleotide sequence encoding an HCV E1/E2 heterodimer is followed by a second (booster) vaccine comprising a recombinant MVA vector that comprises a nucleotide sequence encoding a T-cell epitope polypeptide. Other prime-boost protocols can be used. For example, multiple primes and/or multiple boosts can be administered.

In some cases, a first (priming) immunogenic composition is administered, where the first immunogenic composition comprises one or more of: a) an HCV E1/E2 heterodimer; b) an HCV E2 polypeptide; c) an HCV E1 polypeptide; and d) a T-cell epitope polypeptide, as described above; and a second (boosting) immunogenic composition is administered, where the second immunogenic composition comprises a recombinant viral vector comprising nucleotide sequence(s) encoding one or more of: a) an HCV E1/E2 heterodimer; b) an HCV E2 polypeptide; c) an HCV E1 polypeptide; and d) a T-cell epitope polypeptide, as described above.

In some cases, a first (priming) immunogenic composition is administered, where the first immunogenic composition comprises a recombinant viral vector comprising nucleotide sequence(s) encoding one or more of: a) an HCV E1/E2 heterodimer; b) an HCV E2 polypeptide; c) an HCV E1 polypeptide; and d) a T-cell epitope polypeptide, as described above; and a second (boosting) immunogenic composition is administered, where the second immunogenic composition comprises one or more of: a) an HCV E1/E2 heterodimer; b) an HCV E2 polypeptide; c) an HCV E1 polypeptide; and d) a T-cell epitope polypeptide, as described above.

In some cases, a co-immunization regimen is carried out, in which a polypeptide(s) per se is administered substantially concomitantly with a nucleic acid(s) encoding the polypeptide(s). For example, in some cases, a method of the present disclosure for inducing an immune response to an HCV polypeptide can comprise administering: a) a first immunogenic composition of the present disclosure, as described above, where the immunogenic composition comprises: i) an HCV E1/E2 heterodimer; ii) a T-cell epitope polypeptide; and iii) a pharmaceutically acceptable carrier; or i) an HCV E1 polypeptide; ii) a T-cell epitope polypeptide; and iii) a pharmaceutically acceptable carrier; or i) an HCV E2 polypeptide; ii) a T-cell epitope polypeptide; and iii) a pharmaceutically acceptable carrier; and b) a second immunogenic composition of the present disclosure, as described above, where the immunogenic composition comprises: i) one or more nucleic acids comprising nucleotide sequence encoding one or more of: an HCV E1/E2 heterodimer, an HCV E1 polypeptide, an HCV E2 polypeptide, and a T-cell epitope polypeptide; and ii) a pharmaceutically acceptable carrier. In some cases, the first and the second immunogenic compositions are in a single formulation. In some cases, the first and the second immunogenic compositions are in separate formulations. In some cases, the first and the second immunogenic compositions are administered via the same route of administration. In some cases, the first and the second immunogenic compositions are administered via different routes of administration. In some cases, the first and the second immunogenic compositions are in separate formulations that are administered substantially simultaneously, e.g., within 1 minute, within 1 minute to 5 minutes, within 5 minutes to 15 minutes, or within 15 minutes to 30 minutes, of one another. In some cases, the first and the second immunogenic compositions are administered multiple times to an individual.

In some cases, a co-immunization regimen is carried out, in which a polypeptide(s) per se is administered substantially concomitantly with a nucleic acid(s) encoding the polypeptide(s). For example, in some cases, a method of the present disclosure for inducing an immune response to an HCV polypeptide can comprise administering: a) a first immunogenic composition of the present disclosure, as described above, where the immunogenic composition comprises: i) an HCV E1/E2 heterodimer; ii) a T-cell epitope polypeptide; and iii) a CDN; and b) a second immunogenic composition of the present disclosure, as described above, where the immunogenic composition comprises: i) one or more nucleic acids comprising nucleotide sequences encoding an HCV E1/E2 heterodimer and a T-cell epitope polypeptide; and ii) a CDN. In some cases, the first and the second immunogenic compositions are in a single formulation. In some cases, the first and the second immunogenic compositions are in separate formulations. In some cases, the first and the second immunogenic compositions are administered via the same route of administration. In some cases, the first and the second immunogenic compositions are administered via different routes of administration. In some cases, the first and the second immunogenic compositions are in separate formulations that are administered substantially simultaneously, e.g., within 1 minute, within 1 minute to 5 minutes, within 5 minutes to 15 minutes, or within 15 minutes to 30 minutes, of one another. In some cases, the first and the second immunogenic compositions are administered multiple times to an individual. In some cases, the one or more nucleic acids are recombinant viral vectors.

In some cases, a method of the present disclosure for inducing an immune response to HCV in an individual comprises administering to the individual an effective amount of an immunogenic composition comprising: a) nucleic acid(s) comprising nucleotide sequences encoding 1) an HCV E1/E2 heterodimer and a T-cell epitope polypeptide; 2) an HCV E2 polypeptide and a T-cell epitope polypeptide; 3) an HCV E1 polypeptide and a T-cell epitope polypeptide; 4) an HCV E1/E2 polypeptide; 5) an HCV E2 polypeptide; or 6) an HCV E1 polypeptide; and b) a CDN or an archaeosome. In some cases, the nucleic acid is an RNA comprising nucleotide sequences encoding a polypeptide of the present disclosure (e.g., an HCV E1/E2 heterodimer; an HCV E1 polypeptide; an HCV E2 polypeptide; a T-cell epitope polypeptide, as described herein. See, e.g., Weiner (2013) *Molec. Therapy* 21:506; and Ulmer et al. (2012) *Vaccine* 30:4414. In some cases, an RNA (e.g., a single mRNA molecule; or 2 mRNA molecules; or 3 mRNA molecules) comprising nucleotide sequences encoding a polypeptide of the present disclosure is formulated with a liposome. In some cases, an RNA (e.g., a single mRNA molecule; or 2 mRNA molecules) comprising nucleotide sequences encoding a polypeptide of the present disclosure is complexed with protamine. In some cases, an RNA (e.g., a single mRNA molecule; or 2 mRNA molecules) comprising nucleotide sequences encoding a polypeptide of the present disclosure is complexed with 1,2-dioleoyl-3-trimethylammonium-propane/1,2-dioleoyl-sn-glycero-3-phosphoethanolamine (DOTAP/DOPE).

In some cases, the nucleic acid(s) are present in bacteria (e.g., non-pathogenic bacteria suitable for delivery of nucleic acids to an individual). In some cases, the nucleic acid(s) are present in recombinant expression vector(s) present in bacteria (e.g., non-pathogenic bacteria suitable for delivery of nucleic acids to an individual). In some cases, the bacteria are live. In some cases, the bacteria are live attenuated bacteria. In some cases, the bacteria are killed. Bacteria suitable for delivery of nucleic acid(s) (which may be present in expression vectors) include, but are not limited to, *Lactobacillus; Lactococcus* (e.g., *Lactococcus lactis*); *Salmonella*, e.g., attenuated, non-pathogenic *Salmonella*, e.g., *Salmonella enterica* serovar *typhi, Salmonella enterica* serovar *typhimurium*; non-pathogenic strains of *Escherichia coli*; non-pathogenic strains of *Bordetella pertussis*; non-pathogenic strains of *Listeria*; non-pathogenic strains of *Shigella*; non-pathogenic strains of *Vibrio* (e.g., *Vibrio cholera*); *Streptococcus gordonii*; non-pathogenic strains of *Yersinia enterocolitica*; non-pathogenic strains of *Shigella flexneri*; non-pathogenic strains of *Pseudomonas aeruginosa*; non-pathogenic strains of *Bacillus subtilis*; and the like. In some cases, one or more virulence genes in the bacterium is all or partially deleted. For example, for *Salmonella enterica* serovar *typhi* and *Salmonella enterica* serovar *typhimurium*, an aroA, aroC, and aroD mutation can be made. Other mutations that can attenuate pathogenicity affect biosynthesis of the nucleotides adenine (pur) and guanine (guaBA), and outer membrane proteins C and F (ompC, ompF), as well as expression of the cAMP receptor (cya/crp), the conversion of UDP-galactose to UDP-glucose (galE), DNA recombination and repair (recA, recBC), and regulation of virulence genes (phoP, phoQ). For *Listeria monocytogenes*, attenuation can be achieved with auxotrophic mutants, or deletion of virulence factors such as the genes actA and internalin B (intB).

General Considerations

An immunogenic composition of the present disclosure is generally administered to a human subject who has an HCV infection or who is at risk of acquiring an HCV infection (e.g., is at greater risk than the general population of acquiring an HCV infection) so as to prevent or at least partially arrest the development of disease and its complications. An amount adequate to accomplish this is defined as a "therapeutically effective dose" or a "therapeutically effective amount." "Prophylactic" use of a subject immunogenic composition generally refers to administration to an individual who has not been infected with HCV. "Therapeutic" use of a subject immunogenic composition can refer to "prophylactic" use (administration to an individual who has not been infected with HCV) and/or to administration to an individual who has an HCV infection. A "therapeutically effective amount" of an immunogenic composition of the present disclosure, can be an amount that, when administered in one or more doses to an individual who is not infected with HCV, is effective to induce an immune response in the individual to HCV. A "therapeutically effective amount" of an immunogenic composition of the present disclosure, can be an amount that, when administered in one or more doses to an individual who is infected with HCV, is effective to enhance an immune response in the individual to HCV.

Amounts effective for therapeutic use will depend on, e.g., the manner of administration, the weight and general state of health of the patient, and the judgment of the prescribing physician. Single or multiple doses of a subject immunogenic composition can be administered depending on the dosage and frequency required and tolerated by the patient, and route of administration.

In some cases, an effective amount of an immunogenic composition of the present disclosure is an amount that, when administered to an individual in one or more doses, is effective to induce an antibody response (e.g., a neutralizing antibody response) to HCV in the individual. For example, antibody to HCV (e.g., extracellular HCV), and/or to an HCV-infected cell, can be induced.

An effective amount of an immunogenic composition of the present disclosure can be an amount that, when administered to an individual in one or more doses, is effective to induce a neutralizing antibody response to HCV of a variety of genotypes (e.g., genotype 1; genotype 3; etc.). A neutralizing antibody response reduces binding of HCV to one or more host receptors for HCV and inhibits entry of HCV into a cell.

In some cases, an effective amount (e.g., a therapeutically effective amount) of an immunogenic composition of the present disclosure is an amount that, when administered to an individual in one or more doses, is effective to induce a cytotoxic T lymphocyte (CTL) response to HCV. For example, a CTL response to an HCV-infected cell can be induced.

In some cases, an effective amount (e.g., a therapeutically effective amount) of an immunogenic composition of the present disclosure is an amount that, when administered to an individual in one or more doses, is effective to induce a helper T lymphocyte (e.g., $CD4^+$ T cell) to HCV in an individual.

In some cases, an effective amount (e.g., a therapeutically effective amount) of an immunogenic composition of the present disclosure is an amount that, when administered to an individual in one or more doses, is effective to induce an antibody response (e.g., a neutralizing antibody response) and/or a CTL response and/or a helper T cell response to HCV genotype 1. In some cases, an effective amount (e.g., a therapeutically effective amount) of an immunogenic composition of the present disclosure is an amount that, when administered to an individual in one or more doses, is effective to induce an antibody response (e.g., a neutralizing antibody response) and/or a CTL response and/or a helper T cell response to HCV genotype 3. In some cases, an effective amount (e.g., a therapeutically effective amount) of an immunogenic composition of the present disclosure is an amount that, when administered to an individual in one or more doses, is effective to induce an antibody response (e.g., a neutralizing antibody response) and/or a CTL response and/or a helper T cell response to HCV genotype 1 and HCV genotype 3. In some cases, an effective amount (e.g., a therapeutically effective amount) of an immunogenic composition of the present disclosure is an amount that, when administered to an individual in one or more doses, is effective to induce an antibody response (e.g., a neutralizing antibody response) and/or a CTL response and/or a helper T cell response to HCV of any genotype.

An immunogenic composition of the present disclosure is generally administered in an amount effective to elicit an immune response, e.g., a humoral immune response (e.g., an antibody response) and/or a CTL response, in the mammalian subject. Effective amounts for immunization will vary, and can generally range from about 1 μg to 100 μg per 70 kg patient, e.g., from about 5 μg/70 kg to about 50 μg/70 kg. Substantially higher dosages (e.g. 10 mg to 100 mg or more) may be suitable in oral, nasal, or topical administration routes. The initial administration can be followed by booster immunization of the same immunogenic composition or a different immunogenic composition. In some instances, a subject method of inducing an immune response involves an initial administration of an immunogenic composition of the present disclosure, followed by at least one booster, and in some instances involves two or more (e.g., three, four, or five) boosters. The interval between an initial administration and a booster, or between a give booster and a subsequent booster, can be from about 1 week to about 12 weeks, e.g., from about 1 week to about 2 weeks, from about 2 weeks to about 4 weeks, from about 4 weeks to about 6 weeks, from about 6 weeks to about 8 weeks, from about 8 weeks to about 10 weeks, or from about 10 weeks to about 12 weeks. The interval between an initial administration and a booster, or between a give booster and a subsequent booster, can be from 4 months to 6 months, or from 6 months to 1 year.

In general, immunization can be accomplished by administration of an immunogenic composition of the present disclosure by any suitable route, including administration of the composition orally, nasally, nasopharyngeally, parenterally, enterically, gastrically, topically, transdermally, subcutaneously, intramuscularly, in tablet, solid, powdered, liquid, aerosol form, locally or systemically, with or without added excipients. Actual methods for preparing parenterally administrable compositions will be known or apparent to those skilled in the art and are described in more detail in such publications as Remington's Pharmaceutical Science, 15th ed., Mack Publishing Company, Easton, Pa. (1980). In some instances, immunization is accomplished by intramuscular injection of an immunogenic composition of the present disclosure.

Individuals Suitable for Administration

Individuals who are suitable for administration with an immunogenic composition of the present disclosure include immunologically naïve individuals (e.g., individuals who have not been infected with HCV and/or who have not been administered with an HCV vaccine). Individuals suitable for administration include humans. Individuals who are suitable for administration with an immunogenic composition of the present disclosure are also referred to as "an individual in need thereof."

Individuals who are suitable for administration with an immunogenic composition of the present disclosure composition of the present disclosure include individuals who are at greater risk than the general population of becoming infected with HCV, where such individuals include, e.g., intravenous drug users; individuals who are the recipients, or the prospective recipients, of blood or blood products from another (donor) individual(s); individuals who are the recipients, or the prospective recipients, of non-autologous cells, tissues, or organs from another (donor) individual; health care workers; emergency medical and non-medical personnel (e.g., first responders; fire fighters; emergency medical team personnel; etc.) and the like.

Individuals who are suitable for administration with an immunogenic composition of the present disclosure composition of the present disclosure include individuals who recently became exposed to HCV or who recently became infected with HCV. For example, a subject immunogenic composition can be administered to an individual within from about 24 hours to about 48 hours, from about 48 hours to about 1 week, or from about 1 week to about 4 weeks, following possible or suspected exposure to HCV or following infection with HCV.

Individuals who are suitable for administration with an immunogenic composition of the present disclosure composition of the present disclosure include individuals who have been diagnosed as having an HCV infection, and include chronically infected individuals. In some cases, an individual who has been diagnosed as having an HCV infection is treated with an anti-viral agent and an immunogenic composition of the present disclosure. Suitable anti-viral agents for treating HCV infection include, e.g., ribavirin (1-β-D-ribofuranosyl-1H-1,2,4-triazole-3-carboxamide); interferon-alpha (IFN-α) (where "IFN-α" includes IFN-α2a; IFN-α2b; IFN-α that is conjugated with poly (ethylene glycol) ("pegylated IFN-α), where the pegylated IFN-α can be pegylated IFN-α2a or pegylated IFN-α 2b); an HCV NS3 protease inhibitor (e.g., boceprevir; telaprevir); and an HCV NS5 protease inhibitor. In some cases, an individual who has been diagnosed as having an HCV infection is treated with, e.g.: 1) IFN-α+ribavirin; and an immunogenic composition of the present disclosure; or 2) IFN-α+ribavirin+an HCV protease inhibitor (e.g., boceprevir or telaprevir); and an immunogenic composition of the present disclosure. Suitable anti-viral agents for treating HCV infection include Sovaldi (Sofosbuvir; a nucleotide analog that functions as an NS5B polymerase inhibitor), alone or in combination with pegylated IFN-α and ribavirin.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered 1-136 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Aspect 1. An immunogenic composition comprising: a) an HCV E1/E2 heterodimer; and b) a cyclic dinucleotide (CDN); or a) an HCV E2 polypeptide; and b) a CDN; or a) an HCV E1 polypeptide; and b) a CDN.

Aspect 2. The immunogenic composition of aspect 1A, aspect 1B, or aspect 1C, wherein the CDN is fluorinated.

Aspect 3. The immunogenic composition of aspect 2, wherein the CDN is 2'-F-c-di-GMP.

Aspect 4. The immunogenic composition of aspect 1A, aspect 1B, or aspect 1C, wherein the CDN is of Formula (I):

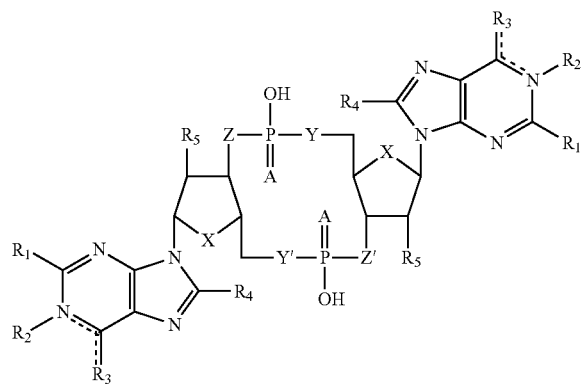

wherein:
A is S or O;
X is S, N, O, CH$_2$;
Y, Y' is NH, CH$_2$, O;
Z, Z' is NH, CH$_2$, O;
R1 represents hydrogen or NH$_2$ which may be substituted;
R2 is hydrogen or absent;
R3 represents NH$_2$, O, OH, H, or a halogen;
R4 represents hydrogen, halogen, or a straight or branched C$_1$-C$_6$ alkyl group which may optionally be substituted;
R5 represents hydrogen, OH or a straight or branched C$_1$-C$_6$ alkyl chain or C$_1$-C$_6$ straight or branched alkoxy chain which may optionally be substituted;
⸺ is a single or double bond;
or conjugates thereof, and salts or solvates thereof.

Aspect 5. The immunogenic composition of aspect 4, wherein the CDN is c-diGMP, c-diAMP, c-diIMP, or c-dXMP.

Aspect 6. The immunogenic composition of aspect 4, wherein the CDN is c-GpAp, c-GpIp, c-GpXp, c-ApIp, c-ApXp, or c-IpXp.

Aspect 7. The immunogenic composition of aspect 1, wherein the CDN is cyclic-GMP-AMP (cGAMP).

Aspect 8. The immunogenic composition of aspect 7, wherein the cGAMP is 2'3'-cGAMP, 2'2'-cGAMP, 3'2'-cGAMP or 3'3'-GAMP.

Aspect 9. The immunogenic composition of any one of aspect aspects 1-8, wherein the composition comprises an HCV E1/E2 heterodimer.

Aspect 10. The immunogenic composition of aspect 9, wherein:
a) the HCV E2 polypeptide is derived from an HCV of major genotype 1, 2, 3, 4, 5, 6, or 7; and
b) the HCV E1 polypeptide is derived from an HCV of major genotype 1, 2, 3, 4, 5, 6, or 7.

Aspect 11. The immunogenic composition of any one of aspects 1-10, wherein the HCV E2 polypeptide comprises an amino acid sequence having at least 20% amino acid sequence identity to an E2 polypeptide depicted in one of FIG. 1A-1C, FIG. 2A-2C, FIG. 3A-3C, and FIG. 4A-4B.

Aspect 12. The immunogenic composition of any one of aspects 1-10, wherein the HCV E1 polypeptide comprises an amino acid sequence having at least 20% amino acid sequence identity to an E1 polypeptide depicted in FIG. 1A-1C, FIG. 2A-2C, FIG. 3A-3C, and FIG. 4A-4B.

Aspect 13. The immunogenic composition of any one of aspects 1-12, wherein the E2 polypeptide and/or the E1 polypeptide lacks a C-terminal transmembrane domain.

Aspect 14. The immunogenic composition of any one of aspects 1-13, wherein the HCV E2 polypeptide and the HCV E1 polypeptide are derived from an HCV of the same genotype.

Aspect 15. The immunogenic composition of any one of aspects 1-13, wherein the HCV E2 polypeptide and the HCV E1 polypeptide are derived from an HCV of different genotypes.

Aspect 16. The immunogenic composition of any one of aspects 1-15, wherein the HCV E1/E2 heterodimeric polypeptide comprises:
a) an HCV E1 polypeptide; and
b) a modified E2 polypeptide comprising, in order from N-terminus to C-terminus:
i) from 1 to 6 heterologous amino acids, wherein the from 1 to 6 heterologous amino acids are C-terminal to a site of proteolytic cleavage in a proteolytically cleavable linker; and
ii) an HCV E2 polypeptide; or
a) an HCV E2 polypeptide; and
b) a modified E1 polypeptide comprising, in order from N-terminus to C-terminus:
i) from 1 to 6 heterologous amino acids, wherein the from 1 to 6 heterologous amino acids are C-terminal to a site of proteolytic cleavage in a proteolyt Aspect 22. The immunogenic composition of any one of aspects 18-20, wherein the T-cell epitope polypeptide has a length of from about 10 amino acids to about 50 amino acids, from about 100 amino acids to about 230 amino acids, from about 230 amino acids to about 550 amino acids, from about 550 amino acids to about 780 amino acids, or from about 780 amino acids to about 2000 amino acids.

Aspect 23. The immunogenic composition of any one of aspects 18-22, wherein the T-cell epitope polypeptide comprises one or more T cell epitopes present in an HCV NS3 polypeptide.

Aspect 24. The immunogenic composition of any one of aspects 18-23, wherein the T-cell epitope polypeptide comprises an amino acid sequence having at least 20% amino acid sequence identity to the amino acid sequence of one of TP29, TP50, TP52, TP70, TP100, TP171, TP228, TP553, TP778, and TP1985.

Aspect 25. The immunogenic composition of aspect any one of aspects 18-24, wherein the T-cell epitope polypeptide comprises an amino acid sequence having at least 20% amino acid sequence identity to a polypeptide depicted in any one of FIGS. 9A, 9B, 10A-10D, and 11A-11N.

Aspect 26. The immunogenic composition of any one of 18-25, wherein the T-cell epitope polypeptide comprises one or more T cell epitopes present in:
a) cholera toxin or toxoid; and/or
b) tetanus toxin or toxoid; and/or
c) diphtheria toxin or toxoid; and/or
d) CRM197.

Aspect 27. The immunogenic composition of any one of aspects 1-25, wherein the composition comprises a polypeptide comprising one or more T cell epitopes present in:
a) cholera toxin or toxoid; and/or
b) tetanus toxin or toxoid; and/or
c) diphtheria toxin or toxoid; and/or
d) CRM197.

Aspect 28. A method of inducing an immune response to HCV in an individual, the method comprising administering to the individual an effective amount of the immunogenic composition of any one of aspects 1-27.

Aspect 29. The method of aspect 28, wherein said administering is via intramuscular administration, intranasal administration, subcutaneous administration, or a combination thereof.

Aspect 30. The method of aspect 28, wherein said administering comprises a prime and a boost.

Aspect 31. An immunogenic composition comprising:
a) one or more nucleic acids comprising nucleotide sequences encoding the hepatitis C virus (HCV) E1 polypeptide, the HCV E2 polypeptide, or the HCV E1/E2 heterodimer as recited in any one of aspects 1-28; and
b) a cyclic dinucleotide as recited in any one of aspects 1-28.

Aspect 32. The immunogenic composition of aspect 31, wherein the one or more nucleic acids are recombinant expression vectors.

Aspect 33. The immunogenic composition of aspect 32, wherein the one or more recombinant expression vectors are recombinant viral vectors.

Aspect 34. The immunogenic composition of aspect 32, wherein the one or more recombinant viral vectors are packaged into viral particles.

Aspect 35. The immunogenic composition of any one of aspects 31-34, wherein the one or more nucleic acids are present within non-pathogenic bacteria.

Aspect 36. A method of inducing an immune response to HCV in an individual, the method comprising administering to the individual an effective amount of any one of aspects 31-35.

Aspect 37. The method of aspect 36, wherein said administering is via intramuscular administration, intranasal administration, subcutaneous administration, or a combination thereof.

Aspect 38. The method of aspect 36, wherein said administering comprises a prime and a boost.

Aspect 39. The method of any one of aspects 28-30 or aspects 36-38, wherein the immune response comprises one or more of a CD4$^+$ response, a CD8$^+$ response, and a neutralizing antibody response.

Aspect 40. The method of any one of aspects 28-30 or aspects 36-38, wherein the immune response induced is to more than one HCV genotype.

Aspect 41. An immunogenic composition comprising: a) an HCV E1/E2 heterodimer; and b) an archaeosome comprising at least one polar synthetic lipid, wherein the at least one polar synthetic lipid comprises at least one carbohydrate or anionic group linked by covalent bonding to at least one free hydroxyl group of an archaeal core lipid; or a) an HCV E2 polypeptide; and b) an archaeosome comprising at least one polar synthetic lipid, wherein the at least one polar synthetic lipid comprises at least one carbohydrate or anionic group linked by covalent bonding to at least one free hydroxyl group of an archaeal core lipid; or a) an HCV E1 polypeptide; and b) an archaeosome comprising at least one polar synthetic lipid, wherein the at least one polar synthetic lipid comprises at least one carbohydrate or anionic group linked by covalent bonding to at least one free hydroxyl group of an archaeal core lipid.

Aspect 42. The immunogenic composition of aspect 41, wherein the archaeal core lipid is archaeol (2,3-di-O-diphytanyl-sn-glycerol).

Aspect 43. The immunogenic composition of aspect 41, wherein the archaeal core lipid is caldarchaeol (2,2',3,3'-tetra-O-dibiphytanyl-sn-diglycerol).

Aspect 44. The immunogenic composition of aspect 41, wherein the carbohydrate group is selected from the group consisting of: β-D-Glc-(1,6)-β-D-Glc-; β-D-Glc-(1,6)-.alpha.-D-Glc-; α-D-Glc-(1,4)-β-D-Glc-; β-D-Gal-(1,4)-13-D-Glc-; α-D-Gal-(1,6)-β-D-Glc-; β-D-Glc-(1,6)-β-D-Glc-(1,6)-β-D-Glc-; α-D-Glc-(1,4)-α-D-Glc-(1,4)-β-D-Glc-; α-D-Man-(1,2)-α-D-Man-(1,2)-α-D-Man-; and α-D-Man-(1,2)-α-D-Man-(1,2)-α-D-Man-(1,2)-α-D-Man-.

Aspect 45. The immunogenic composition of aspect 41, wherein the carbohydrate group comprises two or three β-D-Glc-units in (1,6) linkage.

Aspect 46. The immunogenic composition of aspect 41, wherein the carbohydrate group is a gal-glc-group.

Aspect 47. The immunogenic composition of aspect 41, wherein the anionic group is selected from the group consisting of phosphoserine, phosphoethanolamine, phosphoinositol and phosphoglycerol.

Aspect 48. The immunogenic composition of aspect 41, wherein the at least one polar synthetic lipid comprises at least one anionic lipid.

Aspect 49. The immunogenic composition of aspect 48, wherein the at least one anionic lipid is selected from the group consisting of archaetidylglycerol, archaetidylglycerolphosphate-methyl, archaetidylserine, and archaetidylinositol.

Aspect 50. The immunogenic composition of aspect 48, wherein the archaeosome comprises at least one conventional lipid.

Aspect 51. The immunogenic composition of aspect 50, wherein the at least one conventional lipid is selected from a group consisting of phosphatidylglycerol, phosphatidylserine, SQDG, and cholesterol.

Aspect 52. The immunogenic composition of aspect 51, wherein the at least one conventional lipid comprises cholesterol, and wherein cholesterol is present in an amount of between 10 and 45 mol % of the total lipid composition.

Aspect 53. The immunogenic composition of aspect 51, wherein the phosphatidylglycerol is present in an amount of between 20 and 80 mol % of the lipid composition.

Aspect 54. The immunogenic composition of aspect 51, wherein the phosphatidylserine is present in an amount of between 10 and 30 mol % of the lipid composition.

Aspect 55. The immunogenic composition of aspect 51, wherein the at least one polar synthetic lipid comprises at least one synthetic immunoactive glycolipid and at least one anionic lipid, and the archaeosome further comprises at least one stabilizing lipid.

Aspect 56. The immunogenic composition of aspect 55, wherein the at least one polar synthetic lipid comprises caldarchaeol having one carbohydrate head group and one anionic head group.

Aspect 57. The immunogenic composition of aspect 56, wherein the carbohydrate head group comprises gentiobiose and the anionic head group comprises phosphoinositol.

Aspect 58. The immunogenic composition of aspect 55, wherein the at least one polar synthetic lipid comprises a first caldarchaeol having two carbohydrate head groups and a second caldarchaeol having two anionic head groups, and wherein the at least one stabilizing lipid is the first and/or second caldarchaeol.

Aspect 59. The immunogenic composition of aspect 55, wherein the at least one polar synthetic lipid comprises gentiotriose-archaeol and wherein the at least one stabilizing lipid comprises cholesterol and at least one of phosphatidylethanolamine, archaetidylglycerol, archaetidylserine or archaetidylglycerolphosphate-methyl.

Aspect 60. The immunogenic composition of any one of aspects 41-59, wherein the composition comprises an HCV E1/E2 heterodimer.

Aspect 61. The immunogenic composition of aspect 60, wherein:
a) the HCV E2 polypeptide is derived from an HCV of major genotype 1, 2, 3, 4, 5, 6, or 7; and
b) the HCV E1 polypeptide is derived from an HCV of major genotype 1, 2, 3, 4, 5, 6, or 7.

Aspect 62. The immunogenic composition of any one of aspects 41-61, wherein the HCV E2 polypeptide comprises an amino acid sequence having at least 20% amino acid sequence identity to an E2 polypeptide depicted in one of FIG. 1A-1C, FIG. 2A-2C, FIG. 3A-3C, and FIG. 4A-4B.

Aspect 63. The immunogenic composition of any one of aspects 41-61, wherein the HCV E1 polypeptide comprises an amino acid sequence having at least 20% amino acid sequence identity to an E1 polypeptide depicted in FIG. 1A-1C, FIG. 2A-2C, FIG. 3A-3C, and FIG. 4A-4B.

Aspect 64. The immunogenic composition of any one of aspects 41-63, wherein the E2 polypeptide and/or the E1 polypeptide lacks a C-terminal transmembrane domain.

Aspect 65. The immunogenic composition of any one of aspects 41-64, wherein the HCV E2 polypeptide and the HCV E1 polypeptide are derived from an HCV of the same genotype.

Aspect 66. The immunogenic composition of any one of aspects 41-64, wherein the HCV E2 polypeptide and the HCV E1 polypeptide are derived from an HCV of different genotypes.

Aspect 67. The immunogenic composition of any one of aspects 41-66, wherein the HCV E1/E2 heterodimeric polypeptide comprises:
a) an HCV E1 polypeptide; and
b) a modified E2 polypeptide comprising, in order from N-terminus to C-terminus:
 i) from 1 to 6 heterologous amino acids, wherein the from 1 to 6 heterologous amino acids are C-terminal to a site of proteolytic cleavage in a proteolytically cleavable linker; and
 ii) an HCV E2 polypeptide; or
a) an HCV E2 polypeptide; and
b) a modified E1 polypeptide comprising, in order from N-terminus to C-terminus:
 i) from 1 to 6 heterologous amino acids, wherein the from 1 to 6 heterologous amino acids are C-terminal to a site of proteolytic cleavage in a proteolytically cleavable linker; and
 ii) an HCV E1 polypeptide; or
a) an HCV E1 polypeptide; and
b) a modified E2 polypeptide comprising, in order from N-terminus to C-terminus:
 i) an HCV E2 polypeptide; and
 ii) from 1 to 6 heterologous amino acids, wherein the from 1 to 6 heterologous amino acids are N-terminal to a site of proteolytic cleavage in a proteolytically cleavable linker; or
a) an HCV E2 polypeptide; and
b) a modified E1 polypeptide comprising, in order from N-terminus to C-terminus:
 i) an HCV E1 polypeptide; and
 ii) from 1 to 6 heterologous amino acids, wherein the from 1 to 6 heterologous amino acids are N-terminal to a site of proteolytic cleavage in a proteolytically cleavable linker.

Aspect 68. The immunogenic composition of aspect 67, wherein:
a) the from 1 to 6 heterologous amino acids at the N-terminus of the modified E2 polypeptide or the modified E1 polypeptide are Gly-Pro, Ser, Gly, or Gly-Ser; or
b) the from 1 to 6 heterologous amino acids at the C-terminus of the modified E2 polypeptide or the modified E1 polypeptide are LEVLFQGP (SEQ ID NO:117), ENLYYFQ (SEQ ID NO:150), LVPR (SEQ ID NO:124), I(E/D)GR (SEQ ID NO:125), or DDDDK.

Aspect 69. The immunogenic composition of any one of aspects 41-68, wherein the HCV E1 polypeptide, the HCV E2 polypeptide, or one or both chains of the HCV E1/E2 heterodimer comprises a covalently linked T-cell epitope polypeptide comprising a T-cell epitope present in an HCV protein other than E1 and E2.

Aspect 70. The immunogenic composition of any one of aspects 41-68, comprising a T-cell epitope polypeptide comprising a T-cell epitope present in an HCV protein other than E1 and E2, wherein the T-cell epitope polypeptide is not covalently linked to the HCV E1E2 heterodimer, the HCV E1 polypeptide, or the HCV E2 polypeptide.

Aspect 71. The immunogenic composition of aspect 69 or aspect 70, wherein the T-cell epitope polypeptide comprises one or more T cell epitopes present in one or more of:
a) an HCV non-structural polypeptide-3 (NS3) polypeptide;
b) an HCV non-structural polypeptide-2 (NS2) polypeptide;

c) an HCV non-structural polypeptide-4A (NS4A) polypeptide;

d) an HCV non-structural polypeptide-4B (NS4B) polypeptide;

e) an HCV non-structural polypeptide-5A (NS5A) polypeptide;

f) an HCV non-structural polypeptide-5B (NS5B) polypeptide;

g) an HCV core polypeptide; and h) an HCV p7 polypeptide.

Aspect 72. The immunogenic composition of any one of aspects 69-71, wherein the T-cell epitope polypeptide has a length of from about 10 amino acids to about 3000 amino acids.

Aspect 73. The immunogenic composition of any one of aspects 69-71, wherein the T-cell epitope polypeptide has a length of from about 10 amino acids to about 50 amino acids, from about 100 amino acids to about 230 amino acids, from about 230 amino acids to about 550 amino acids, from about 550 amino acids to about 780 amino acids, or from about 780 amino acids to about 2000 amino acids.

Aspect 74. The immunogenic composition of any one of aspects 69-73, wherein the T-cell epitope polypeptide comprises one or more T cell epitopes present in an HCV NS3 polypeptide.

Aspect 75. The immunogenic composition of aspect any one of aspects 69-74, wherein the T-cell epitope polypeptide comprises an amino acid sequence having at least 20% amino acid sequence identity to the amino acid sequence of one of TP29, TP50, TP52, TP70, TP100, TP171, TP228, TP553, TP778, and TP1985.

Aspect 76. The immunogenic composition of aspect any one of aspects 69-74, wherein the T-cell epitope polypeptide comprises an amino acid sequence having at least 20% amino acid sequence identity to a polypeptide depicted in any one of FIGS. 9A, 9B, 10A-10D, and 11A-11N.

Aspect 77. The immunogenic composition of any one of 69-76, wherein the T-cell epitope polypeptide comprises one or more T cell epitopes present in:

a) cholera toxin or toxoid; and/or
b) tetanus toxin or toxoid; and/or
c) diphtheria toxin or toxoid; and/or
d) CRM197.

Aspect 78. The immunogenic composition of any one of aspects 41-76, wherein the composition comprises a polypeptide comprising one or more T cell epitopes present in:

a) cholera toxin or toxoid; and/or
b) tetanus toxin or toxoid; and/or
c) diphtheria toxin or toxoid; and/or
d) CRM197.

Aspect 79. A method of inducing an immune response to HCV in an individual, the method comprising administering to the individual an effective amount of the immunogenic composition of any one of aspects 41-78.

Aspect 80. The method of aspect 79, wherein said administering is via intramuscular administration, intranasal administration, subcutaneous administration, or a combination thereof.

Aspect 81. The method of aspect 79, wherein said administering comprises a prime and a boost.

Aspect 82. An immunogenic composition comprising:

a) one or more nucleic acids comprising nucleotide sequences encoding the hepatitis C virus (HCV) E1 polypeptide, the HCV E2 polypeptide, or the HCV E1/E2 heterodimer as recited in any one of aspects 41-78; and b) an archaeosome as recited in any one of aspects 41-78.

Aspect 83. The immunogenic composition of aspect 82, wherein the one or more nucleic acids are recombinant expression vectors.

Aspect 84. The immunogenic composition of aspect 83, wherein the one or more recombinant expression vectors are recombinant viral vectors.

Aspect 85. The immunogenic composition of aspect 84, wherein the one or more recombinant viral vectors are packaged into viral particles.

Aspect 86. The immunogenic composition of any one of aspects 82-84, wherein the one or more nucleic acids are present within non-pathogenic bacteria.

Aspect 87. A method of inducing an immune response to HCV in an individual, the method comprising administering to the individual an effective amount of any one of aspects 82-86.

Aspect 88. The method of aspect 87, wherein said administering is via intramuscular administration, intranasal administration, subcutaneous administration, or a combination thereof.

Aspect 89. The method of aspect 87, wherein said administering comprises a prime and a boost.

Aspect 90. The method of any one of aspects 79-81 or aspects 87-89, wherein the immune response comprises one or more of a $CD4^+$ response, a $CD8^+$ response, and a neutralizing antibody response.

Aspect 91. The method of any one of aspects 79-81 or aspects 87-89, wherein the immune response induced is to more than one HCV genotype.

Aspect 92. An immunogenic composition comprising:

a) a T-cell epitope polypeptide comprising a T-cell epitope present in a hepatitis C virus (HCV) protein other than E1 and E2; and b) a cyclic dinucleotide (CDN).

Aspect 93. The immunogenic composition of aspect 92, wherein the CDN is fluorinated.

Aspect 94. The immunogenic composition of aspect 93, wherein the CDN is 2'-F-c-di-GMP.

Aspect 95. The immunogenic composition of aspect 92, wherein the CDN is of Formula wherein:
A is S or O;
X is S, N, O, $CH_2$;
Y, Y' is NH, $CH_2$, O;
Z, Z' is NH, $CH_2$, O;
R1 represents hydrogen or $NH_2$ which may be substituted;
R2 is hydrogen or absent;
R3 represents $NH_2$, O, OH, H, or a halogen;

R4 represents hydrogen, halogen, or a straight or branched $C_1$-$C_6$ alkyl group which may optionally be substituted;

R5 represents hydrogen, OH or a straight or branched $C_1$-$C_6$ alkyl chain or $C_1$-$C_6$ straight or branched alkoxy chain which may optionally be substituted;

⎓ is a single or double bond;

or conjugates thereof, and salts or solvates thereof.

Aspect 96. The immunogenic composition of aspect 95, wherein the CDN is c-diGMP, c-diAMP, c-diIMP, or c-dXMP.

Aspect 97. The immunogenic composition of aspect 95, wherein the CDN is c-GpAp, c-GpIp, c-GpXp, c-ApIp, c-ApXp, or c-IpXp.

Aspect 98. The immunogenic composition of aspect 92, wherein the CDN is cyclic-GMP-AMP (cGAMP).

Aspect 99. The immunogenic composition of aspect 98, wherein the cGAMP is 2'3'-cGAMP, 2'2'-cGAMP, 3'2'-cGAMP or 3'3'-GAMP.

Aspect 100. The immunogenic composition of any one of aspects 92-99, wherein the T-cell epitope polypeptide comprises one or more T cell epitopes present in one or more of:
  a) an HCV non-structural polypeptide-3 (NS3) polypeptide;
  b) an HCV non-structural polypeptide-2 (NS2) polypeptide;
  c) an HCV non-structural polypeptide-4A (NS4A) polypeptide;
  d) an HCV non-structural polypeptide-4B (NS4B) polypeptide;
  e) an HCV non-structural polypeptide-5A (NS5A) polypeptide;
  f) an HCV non-structural polypeptide-5B (NS5B) polypeptide;
  g) an HCV core polypeptide; and
  h) an HCV p7 polypeptide.

Aspect 101. The immunogenic composition of any one of aspects 92-100, wherein the T-cell epitope polypeptide has a length of from about 10 amino acids to about 3000 amino acids.

Aspect 102. The immunogenic composition of any one of aspects 92-100, wherein the T-cell epitope polypeptide has a length of from about 10 amino acids to about 50 amino acids, from about 100 amino acids to about 230 amino acids, from about 230 amino acids to about 550 amino acids, from about 550 amino acids to about 780 amino acids, or from about 780 amino acids to about 2000 amino acids.

Aspect 103. The immunogenic composition of any one of aspects 92-102, wherein the T-cell epitope polypeptide comprises one or more T cell epitopes present in an HCV NS3 polypeptide.

Aspect 104. The immunogenic composition of aspect any one of aspects 92-103, wherein the T-cell epitope polypeptide comprises an amino acid sequence having at least 20% amino acid sequence identity to the amino acid sequence of one of TP29, TP50, TP52, TP70, TP100, TP171, TP228, TP553, TP778, and TP1985.

Aspect 105. The immunogenic composition of aspect any one of aspects 1-20, wherein the T-cell epitope polypeptide comprises an amino acid sequence having at least 20% amino acid sequence identity to a polypeptide depicted in any one of FIGS. 9A, 9B, 10A-10D, and 11A-11N.

Aspect 106. The immunogenic composition of any one of 92-105, wherein the T-cell epitope polypeptide comprises one or more T cell epitopes present in:
  a) cholera toxin or toxoid; and/or
  b) tetanus toxin or toxoid; and/or
  c) diphtheria toxin or toxoid; and/or
  d) CRM197.

Aspect 107. The immunogenic composition of any one of aspects 92-105, wherein the composition comprises a polypeptide comprising one or more T cell epitopes present in:
  a) cholera toxin or toxoid; and/or
  b) tetanus toxin or toxoid; and/or
  c) diphtheria toxin or toxoid; and/or
  d) CRM197.

Aspect 108. A method of inducing an immune response to an antigen in an individual, the method comprising administering to the individual an effective amount of:
  a) the composition of any one of aspects 92-107; and
  b) the antigen.

Aspect 109. An immunogenic composition comprising:
  a) a T-cell epitope polypeptide comprising a T-cell epitope present in a hepatitis C virus (HCV) protein other than E1 and E2; and
  b) an archaeosome comprising at least one polar synthetic lipid, wherein the at least one polar synthetic lipid comprises at least one carbohydrate or anionic group linked by covalent bonding to at least one free hydroxyl group of an archaeal core lipid.

Aspect 110. The immunogenic composition of aspect 109, wherein the archaeal core lipid is archaeol (2,3-di-O-diphytanyl-sn-glycerol).

Aspect 111. The immunogenic composition of aspect 109, wherein the archaeal core lipid is caldarchaeol (2,2',3,3'-tetra-O-dibiphytanyl-sn-diglycerol).

Aspect 112. The immunogenic composition of aspect 109, wherein the carbohydrate group is selected from the group consisting of: β-D-Glc-(1,6)-β-D-Glc-; β-D-Glc-(1,6)-.alpha.-D-Glc-; .alpha.-D-Glc-(1,6)-β-D-Glc-; β-D-Glc-(1,4)-β-D-Glc-; α-D-Glc-(1,4)-β-D-Glc-; β-D-Gal-(1,4)-β-D-Glc-; α-D-Gal-(1,6)-β-D-Glc-; β-D-Glc-(1,6)-β-D-Glc-(1,6)-β-D-Glc-; α-D-Glc-(1,4)-α-D-Glc-(1,4)-β-D-Glc-; α-D-Man-(1,2)-α-D-Man-(1,2)-α-D-Man-; and α-D-Man-(1,2)-α-D-Man-(1,2)-α-D-Man-(1,2)-α-D-Man-.

Aspect 113. The immunogenic composition of aspect 109, wherein the carbohydrate group comprises two or three β-D-Glc-units in (1,6) linkage.

Aspect 114. The immunogenic composition of aspect 109, wherein the carbohydrate group is a gal-glc-group.

Aspect 115. The immunogenic composition of aspect 109, wherein the anionic group is selected from the group consisting of phosphoserine, phosphoethanolamine, phosphoinositol and phosphoglycerol.

Aspect 116. The immunogenic composition of aspect 109, wherein the at least one polar synthetic lipid comprises at least one anionic lipid.

Aspect 117. The immunogenic composition of aspect 116, wherein the at least one anionic lipid is selected from the group consisting of archaetidylglycerol, archaetidylglycerolphosphate-methyl, archaetidylserine, and archaetidylinositol.

Aspect 118. The immunogenic composition of aspect 116, wherein the archaeosome comprises at least one conventional lipid.

Aspect 119. The immunogenic composition of aspect 118, wherein the at least one conventional lipid is selected from a group consisting of phosphatidylglycerol, phosphatidylserine, SQDG, and cholesterol.

Aspect 120. The immunogenic composition of aspect 119, wherein the at least one conventional lipid comprises cholesterol, and wherein cholesterol is present in an amount of between 10 and 45 mol % of the total lipid composition.

Aspect 121. The immunogenic composition of aspect 119, wherein phosphatidylglycerol is present in an amount of between 20 and 80 mol % of the lipid composition.

Aspect 122. The immunogenic composition of aspect 119, wherein phosphatidylserine is present in an amount of between 10 and 30 mol % of the lipid composition.

Aspect 123. The immunogenic composition of aspect 109, wherein the at least one polar synthetic lipid comprises at least one synthetic immunoactive glycolipid and at least one anionic lipid, and the archaeosome further comprises at least one stabilizing lipid.

Aspect 124. The immunogenic composition of aspect 123, wherein the at least one polar synthetic lipid comprises caldarchaeol having one carbohydrate head group and one anionic head group.

Aspect 125. The immunogenic composition of aspect 124, wherein the carbohydrate head group comprises gentiobiose and the anionic head group comprises phosphoinositol.

Aspect 126. The immunogenic composition of aspect 123, wherein the at least one polar synthetic lipid comprises a first caldarchaeol having two carbohydrate head groups and a second caldarchaeol having two anionic head groups, and wherein the at least one stabilizing lipid is the first and/or second caldarchaeol.

Aspect 127. The immunogenic composition of aspect 123, wherein the at least one polar synthetic lipid comprises gentiotriose-archaeol and wherein the at least one stabilizing lipid comprises cholesterol and at least one of phosphatidylethanolamine, archaetidylglycerol, archaetidylserine or archaetidylglycerolphosphate-methyl.

Aspect 128. The immunogenic composition of any one of aspects 109-127, wherein the T-cell epitope polypeptide comprises one or more T cell epitopes present in one or more of:
 a) an HCV non-structural polypeptide-3 (NS3) polypeptide;
 b) an HCV non-structural polypeptide-2 (NS2) polypeptide;
 c) an HCV non-structural polypeptide-4A (NS4A) polypeptide;
 d) an HCV non-structural polypeptide-4B (NS4B) polypeptide;
 e) an HCV non-structural polypeptide-5A (NS5A) polypeptide;
 f) an HCV non-structural polypeptide-5B (NS5B) polypeptide;
 g) an HCV core polypeptide; and
 h) an HCV p7 polypeptide.

Aspect 129. The immunogenic composition of any one of aspects 109-128, wherein the T-cell epitope polypeptide has a length of from about 10 amino acids to about 3000 amino acids.

Aspect 130. The immunogenic composition of any one of aspects 109-128, wherein the T-cell epitope polypeptide has a length of from about 10 amino acids to about 50 amino acids, from about 100 amino acids to about 230 amino acids, from about 230 amino acids to about 550 amino acids, from about 550 amino acids to about 780 amino acids, or from about 780 amino acids to about 2000 amino acids.

Aspect 131. The immunogenic composition of any one of aspects 109-130, wherein the T-cell epitope polypeptide comprises one or more T cell epitopes present in an HCV NS3 polypeptide.

Aspect 132. The immunogenic composition of aspect any one of aspects 109-131, wherein the T-cell epitope polypeptide comprises an amino acid sequence having at least 20% amino acid sequence identity to the amino acid sequence of one of TP29, TP50, TP52, TP70, TP100, TP171, TP228, TP553, TP778, and TP1985.

Aspect 133. The immunogenic composition of aspect any one of aspects 109-132, wherein the T-cell epitope polypeptide comprises an amino acid sequence having at least 20% amino acid sequence identity to a polypeptide depicted in any one of FIGS. 9A, 9B, 10A-10D, and 11A-11N.

Aspect 134. The immunogenic composition of any one of 109-133, wherein the T-cell epitope polypeptide comprises one or more T cell epitopes present in:
 a) cholera toxin or toxoid; and/or
 b) tetanus toxin or toxoid; and/or
 c) diphtheria toxin or toxoid; and/or
 d) CRM197.

Aspect 135. The immunogenic composition of any one of aspects 109-133, wherein the composition comprises a polypeptide comprising one or more T cell epitopes present in:
 a) cholera toxin or toxoid; and/or
 b) tetanus toxin or toxoid; and/or
 c) diphtheria toxin or toxoid; and/or
 d) CRM197.

Aspect 136. A method of inducing an immune response to an antigen in an individual, the method comprising administering to the individual an effective amount of:
 a) the composition of any one of aspects 109-135; and
 b) the antigen.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Figure 13:
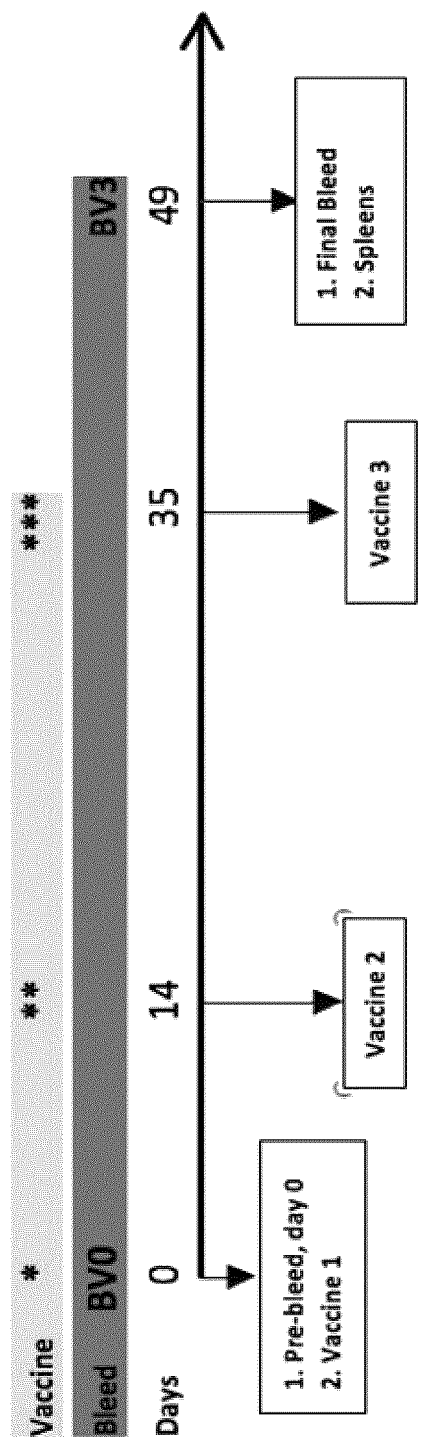
FIG. 13 depicts the experimental protocol.

Example 1: Induction of an Immune Response with HCV E1/E2 and a CDN or an Archaeosome Various adjuvants including MF59, aluminum hydroxide/monophosphoryl lipid A (Alum/MPLA), cyclic di-adenosine monophosphate (C-di-AMP) and archaeosomes, were formulated with rE1E2 to immunize mice. 6-8 weeks mice were immunized three times on day 0, day 14, and day 35 and sera was collected two weeks after last immunization (FIG. 13). The ability of the antibodies to neutralize HCV was evaluated using HCV pseudo-particle (HCVpp) carrying a luciferase reported gene, where the particles were incubated with serum before culturing and the level of luciferase expression was used to measure the neutralization activity of the given serum. Spleens were also collected, and isolated splenocytes were restimulated ex vivo with short peptides to evaluate cellular immunity using multicolor flow cytometry to detect intracellular production of cytokines. Different groups of mice received rE1E2 formulated with MF59, Alum/MPLA, C-di-AMP, or archaeosomes along with appropriate controls FIG. 13 depicts the immunization protocol.

Results

Figure 14:
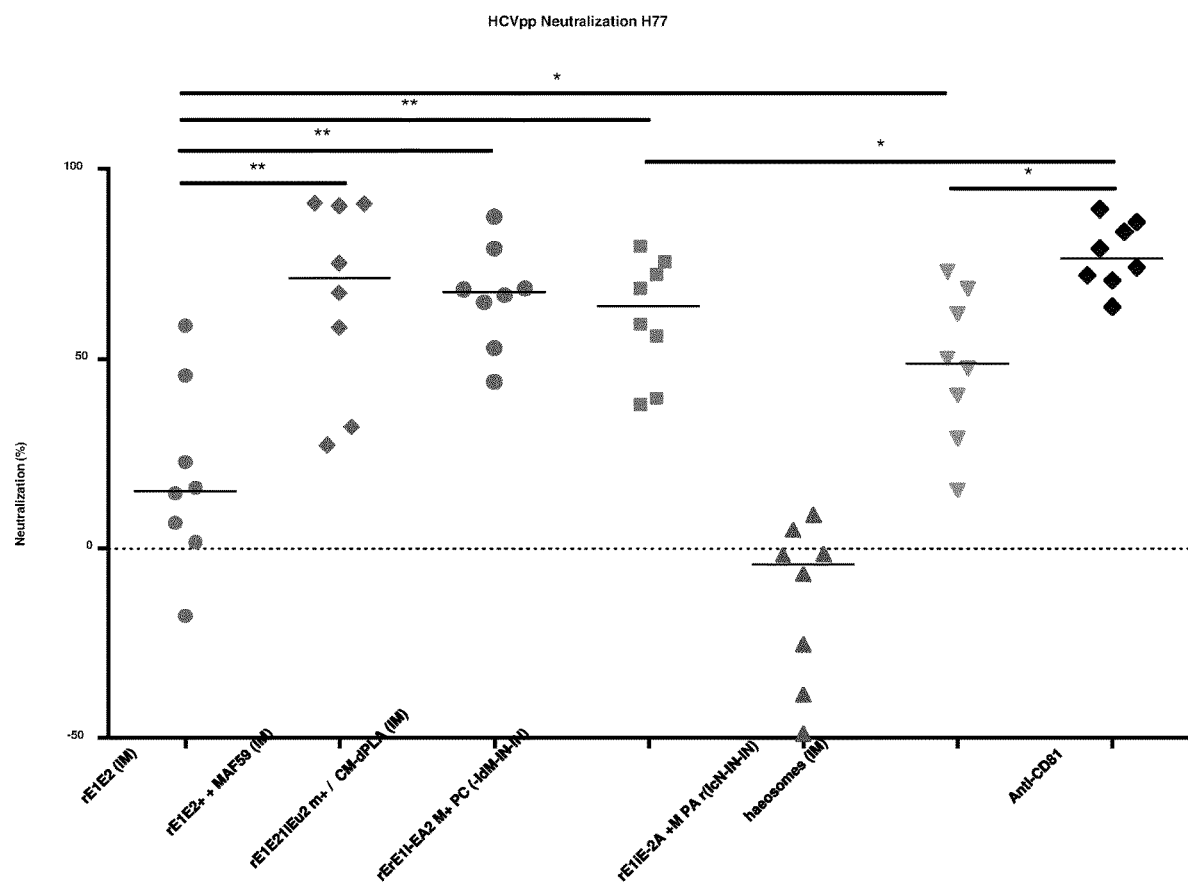
FIG. 14 depicts neutralization activity of recombinant E1E2 (rE1E2), in combination with adjuvant, in mice.

The Sera Collected from Immunized Mice is Able to Neutralize and Prevent the Entry of HCV Pseudo-Particles In Vitro:

As compared to the controls, the sera collected from immunized mice with adjuvanted rE1E2, showed significant increase in preventing the entry of HCVpp in an in vitro neutralization assay (FIG. 14). When the antigen was formulated with MF59 or Alum-MPLA, this effect was highly comparable to neutralization activity of anti-CD81 against HCVpp. However, this effect was lower than that of anti-CD81 in the case of C-di-AMP and archaeosomes formulations. The route seemed to be playing a significant role for C-di-AMP, since the sera from mice with three intranasal administration (IN-IN-IN) of rE1E2+C-di-AMP did not neutralize HCVpp, as opposed to an intramuscular immunization followed by two intranasal boost (IM-IN-IN) regimen.

FIG. 14. Neutralization Activity of rE1E2 in Combination with Adjuvant in Mice.

The sera from mice immunized with rE1E2 were able to neutralize the entry of HCV pseudoparticle in vitro. Percentage of neutralization was calculated based on the neutralizing activity for post-vaccination bleed divided by neutralization activity of pre-vaccination bleed.

Horizontal lines are the medians in each group.

**=p value <0.01; *=p value <0.05.

Robust T Cell Immune Response in C-di-AMP and Archaeosomes Groups:

In vitro stimulation of mice splenocytes with a pool of 55 peptides that span the whole length of HCV E1E2 induced a strong memory T cell response in the groups, where the antigen was formulated with C-di-AMP and archaeosomes (p value <0.005). A moderate response was also detected in Alum/MPLA group (p value <0.05). The data show that while C-di-AMP and archaesomes elicit strong neutralizing antibodies comparable to MF59 and Alum/MPLA, both induced a more robust cellular immune response which was confirmed by the detection of vaccine-specific poly-functional CD4+ T cells (FIG. 15).

Figure 15:
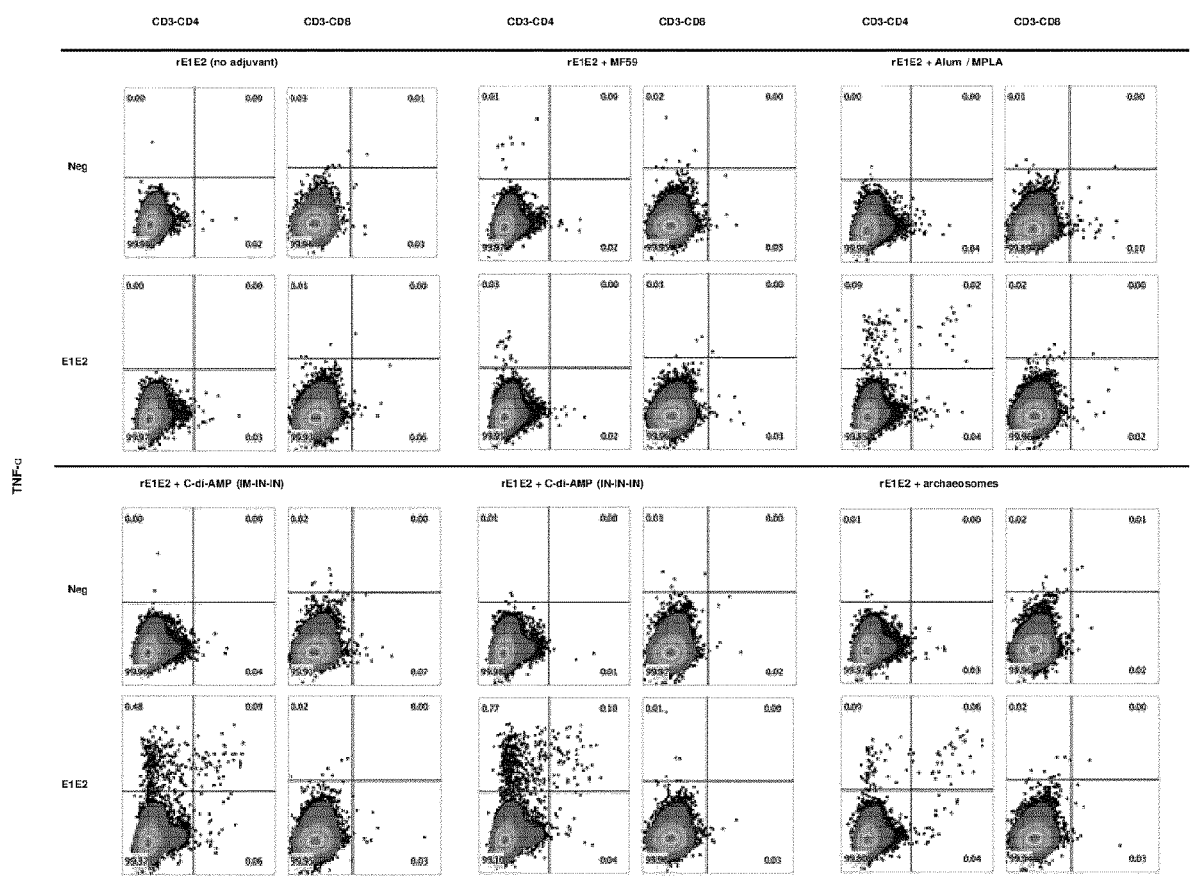
FIG. 15 depicts differential detection of T cell immune responses in mice.

FIG. 15. Differential Detection of T Cell Immune Response in Mice.

The splenocytes from vaccinated mice with rE1E2 in combination with different adjuvants were stimulated in vitro and intracellular production of cytokine was detected by multi-color flow cytometry. IM=Intramuscular; IN=Intranasal; Neg=Negative control splenocytes; E1E2=Splenocytes that are stimulated with a pool of 55 peptides spanning E1E2.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (151 sequences)

SEQ ID NO: 1 - protein, 746 aa, Hepatitis C virus
  misc_feature (248)..(248): Xaa can be any amino acid
  misc_feature (262)..(262): Xaa can be any amino acid
  misc_feature (270)..(270): Xaa can be any amino acid
  misc_feature (275)..(275): Xaa can be any amino acid
  misc_feature (399)..(399): Xaa can be any amino acid
  misc_feature (408)..(408): Xaa can be any amino acid
  misc_feature (524)..(524): Xaa can be any amino acid
  misc_feature (580)..(580): Xaa can be any amino acid
  misc_feature (641)..(641): Xaa can be any amino acid
  misc_feature (709)..(709): Xaa can be any amino acid
  misc_feature (733)..(733): Xaa can be any amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASRCWVALTPTVAXRDGSLPTTQLRRHXDLLVGSAXLCSAXYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAETHVTGGSAARATSGXASLFSPGAXQNIQLINTNGSWHINRTALNCNDSLDTGWVAGLFYYHKFNSSGCPERMASCRPLADFDQGWGPISYANGSGPDQRPYCWHYPPKPCGIVPAQQVCGPVYCFTPSPVVVGTTDRLGXPTYNWGENETDVLVLNNTRPPLGNWFGCTWMNSTGFTKVCGAPPCNIGGVGNNTLXCPTDCFRKHPEATYSRCGSGPWLTPRCLVDYPYRLWHYPCTVNYTIFKVRMYVGGVEHRLXAACNWTRGERCDLDDRDRSELSPLLLSTTQWQVLPCSFTTLPALSTGLIHLHQNIVDVQYLYGVGSSXVSWAIKWEYVILLFLLLADARICXCLWMMLLISQAEA

SEQ ID NO: 2 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNTSRCWVAMTPTVATRDGKLPTTQLRRHIDLLVGSATLCSALYVGDLCGSIFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDTDVFVLNNTRPPLGNWFGCTWMNSTGFTKVCGAPPCVIGGAGNNTLRCPTDCFRKHPDATYSRCGSGPWITPRCLVDYPYRLWHYPCTVNYSIFKIRMYLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEA

SEQ ID NO: 3 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGSAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEA

SEQ ID NO: 4 - protein, 746 aa, Hepatitis C virus
MSTNPKPQRKTKRNTNRRPQDVKFPGGGQIVGGVYLLPRRGPRLGVRAVRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGIYHVTNDCPNSSIVYETADTILHSPGCVPCVREGNASKCWVALAPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFAGVDAETYTTGGSVAQAAFGLTSLFRPGPKQDIQLINTNGSWHINRTALNCNASLDTGWVAGLFYYHKFNSSGCPERMASCRSLADFDQGWGPISYANGSGPEHRPYCWHYPPKPCGIVPAQNVCGPVYCFTPSPVVVGTTNKLGVPTYSWGSNETDVLVLNNTRPPLGNWFGCTWMNSSGFTKVCGAPPCVIGGAGNRTLHCPTDCFRKHPEATYSRCGSGPWITPRCLVHYPYRLWHYPCTVNYTMFKVRMYVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 5 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRSWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAFQVRNSSGLYHVTNDCPNSSIVYETADTILHSPGCVPCVREDNTSRCWVAVAPTVATRDGRLPTTQLRRHIDLLVGSATLCSALYVGDLCGSVFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFASVDAETYTSGGSVARATAGFAGIFNPGAKQDIQLINTNGSWHINRTALNCNASLDTGWVAGLFYYHKFNSSGCPERMASCKPLAHFAQGWGPISYANGSGPDHRPYCWHYPPKPCGIVPAQNVCGPVYCFTPSPVVVGTTNKLGAPTYNWGSNDTDVFILNNTRPPGGNWFGCTWMNSSGFTKVCGAPPCTIGGVGNNTLLCPTDCFRKHPEATYSRCGSGPWVTPRFLVHYPYRLWHYPCTVNYTLFKVRMYVGGVEHRLEVACNWTRGERCDLDDRDRSELSPLLLSTTQWQVLPCSFTTLPALTTGLIHLHQNIVDVQYLYGVGSSLVSWAIKWEYVILLFLLLADARICSCLWMMLLISQAEA

SEQ ID NO: 6 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNTSKCWVAVAPTVATRDGKLPTTQLRRHIDLLVGSATLCSALYVGDLCGSVFLVGQLFTFSPRRHWTTQDCNCSIYPGHITGHRMAWDMMMNWSPTAALVTAQLLRVPQAILDMIAGAHWGVLAGIAYFSMAGNWAKVLLVLLLFAGVDAETYTTGGSVARTTRGLASLLQVGPKQDIRLIHTNGSWHINRTALNCNASLDTGWLAGLLYYHKFNSSGCPERMASCRPLADFDQGWGPISYANGSGPEHRPYCWHYPPKPCGIVPAQTVCGPVYCFTPSPVVVGTTNKLGVPTYTWGSNDTDVFVLNNTRPPLGNWFGCTWMNSTGFTKVCGAPPCVIGGVGNNTLHCPTDCFRKHPEATYSRCGSGPWITPRCLVDYPYRLWHYPCTVNYTLFKVRMYVGGVEHRLQAACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 7 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREDNASRCWVPVAPTVATRDGKLPTTQLRRHIDLLVGSATLCSALYVGDLCGSVFLVSQLFTFSPRRHWTTQDCNCSIYPGHITGHRMAWDMMMNWSPTVALVMAQLLRVPQAILDMIAGAHWGVLAGIAYFSMVGNWAKVLVVLLLFAGVDAQTYVTGGSAARGASGLANLFTPGAKQDIQLINTNGSWHINRTALNCNASLDTGWVAGLFYYHKFNSSGCPERMASCKPLADFDQGWGPIRHANGSGPEHRPYCWHYPPKPCGIVSAQTVCGPVYCFTPSPVVVGTTNRLGVPTYSWGTNDTDVFVLNNTRPPLGNWFGCTWMNSSGFTKVCGAPPCVIGGVGNNTLHCPTDCFRKHPEATYSRCGSGPWITPRCLVHYPYRLWHYPCTVNYTLFKVRMYVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 8 - protein, 746 aa, Hepatitis C virus
MSTNPKPQRKTKRNTNRRPQDVKFPGGGQIVGGVYLLPRRGPRLGVRTTRKTSERSEPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETKDTILHSPGCVPCVREGNVSKCWVPVALTVATRDGNLPTTQLRRHIDLLVGSATLCSALYVGDLCGSVFLVGQLFTFSPRRHWTTQDCNCSMYPGHITGHRMAWDMMMNWSPTSALVVAQLLRVPQAILDMIAGAHWGVLAGLAYFSMVGNWAKVLVVLLLFASVDAGTHVTGGSAAHDVSALAGFFRRGAKQNIQLINTNGSWHVNRTALNCNASLDTGWVAGLLYYHRFNSSGCPERMASCRPLADFDQGWGPITNVDGGGSEYRPYCWHYPPKPCGIEPAQNVCGPVYCFTPSPVVVGTTDKVGVPTYNWGENDTDVFVLNNTRPPLGNWFGCTWMNSSGFVKVCGAPPCIIGGAGNKTLHCPTDCFRKHPDATYSRCGSGPWLTPRCLVDYPYRLWHYPCTVNYTLFKIRMYVGGVEHRLVAACNWTYGERCNLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 9 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVAPTVATRDGTLPTTQLRRHIDLLVGGATLCSALYVGDLCGSVFLVGQLFTFSPRRHWTTQDCNCSIYPGHITGHRMAWDMMMNWSPTTALIVAQLLRVPQAILDMIAGAHWGVLAGIAYFSMVGNWAKVLVVLLLFAGVDAETHVTGGSAAQVTSRVAGFFNPGPKQNVQLINTNGSWHINRTALNCNASLDTGWVAGLFYHYNFNSSGCPERMASCRPLADFDQGWGPISYANGSGPEHRPYCWHYPPKPCGIVPAQNVCGPVYCFTPSPVVVGTTNRLGVPTYNWGSNDTDVFVLNNTRPPLGNWFGCTWMNSSGFTKVCGAPPCVIGGVGNNTLHCPTDCFRKHPEATYSRCGSGPWITPRCLVHYPYRLWHYPCTVNYTLFKVRMYVGGVEHRLEAACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 10 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRSWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGIYHVTNDCPNSSIVYETADTILHSPGCVPCVREGNASKCWVALAPTVATRDGRLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAHTRVTGGSAARATARLTTLFSPGAKQDIQLINTNGSWHINRTALNCNASLDTGWVAGLFYYHKFNSSGCPERMASCRPLADFDQGWGPISYANGSGPEHRPYCWHYPPKPCGIIPAKTVCGPVYCFTPSPVVVGTTDRSGAPTFNWGDNDTDVLVLNNTRPPLGNWFGCTWMNSSGYTKVCGAPPCIIGGVGNNTLHCPTDCFRKHPEATYSRCGSGPWITPRCLVHYPYRLWHYPCTVNYTLFKVRMYVGGVEHRLEAACNWTRGERCNLDDRDRSELSPLLLSTTQWQVLPCSFTTLPALTTGLIHLHQNIVDVQYLYGVGSSIVSWAIKWEYVILLFLLLADARVCSCLWMMLLISQVEA

SEQ ID NO: 11 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVTPTVATRDGRLPATQLRRHIDLLVGSATLCSALYVGDLCGSIFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFAGVDAGTHVTGGSAAKDTSGFTSLFRIGARQNIQLINSNGSWHINRTALNCNESLDTGWVAGLLYYHKFNSSGCPERMASCRSLADFDQGWGPISYANGSGPEHRPYCWHYPPKPCGIVPAQSVCGPVYCFTPSPVVVGTTDKSGAPTYNWGCNETDVFVLNNTRPPLGNWFGCTWMNSSGFTKVCGAPPCVIGGVGNNTLHCPTDCFRKHPEATYSRCGSGPWITPRCLVHYAYRLWHYPCTVNYTLFKVRMYVGGVEHRLDVACNWTRGERCNLDDRDRSELSPLLLSTTQWQVLPCSFTTLPALSTGLIHLHQNIVDVQYLYGVGSSIVSWAIKWEYVILLFLLLADARICSCLWMMLLISQAEA

SEQ ID NO: 12 - protein, 746 aa, Hepatitis C virus; identical to SEQ ID NO: 11

SEQ ID NO: 13 - protein, 746 aa, Hepatitis C virus; identical to SEQ ID NO: 11

SEQ ID NO: 14 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADSILHSPGCVPCVREGNASKCWVAVAPTVATRDGKLPATQLRRHIDLLVGSATLCSALYVGDLCGSVFLVSQLFTFSPRRHWTTQDCNCSIYPGHITGHRMAWDMMMNWSPTTALVVSQLLRVPQAILDMIAGAHWGVLAGIAYFSMVGNWAKVLVVLLLFAGVDAETHTTGGSAAYATSGFVGLFRQGAKQNIQLINTNGSWHVNRTALNCNASLDTGWVAGLFYYHKFNSSGCPERLASCKPLANFDQGWGSISYTNGSGPEHRPYCWHYPPKPCGIVPAQNVCGPVYCFTPSPVVVGTTDRLGAPTFNWGENESDVFVLNNTRPPSGNWFGCTWMNSSGFTKVCGAPPCNIGGVGNNTLHCPTDCFRKHPEATYSRCGSGPWVTPRCLVHYPYRLWHYPCTLNYSLFKVRMYVGGIEHRLEVACNWTRGERCNLDDRDRSELSPLLLTTTQWQVLPCSFTTLPALTTGLIHLHQNVVDVQYLYGVGSSIVSWAIKWEYVILLFLLLADARICSCLWMMLLISQAEA

SEQ ID NO: 15 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVAPTVATRDGRLPTTQLRRHIDLLVGSATLCSALYVGDLCGSVFLVGQLFTFSPRHHWTTQDCNCSIYPGHITGHRMAWDMMMNWSPTTALVVAQLLRVPQAILDMIAGAHWGVLAGIAYFSMVGNWAKVLVVLLLFAGVDATTHTTGGAVAHNTRMFTSIFSLGPRQEIQLVNTNGSWHINRTALNCNASLETGWIAGLLYANRFNSSGCPERMASCKPLADFDQGWGPISYANGSGPEHRPYCWHYPPKPCGIVPAQNVCGPVYCFTPSPVVVGTTDRLGTPTYDWGSNDTDVFVLNNTRPPAGNWFGCTWMNSSGYTKVCGAPPCVIGGVSNNTLHCPTDCFRKHPEATYSRCGSGPWITPRCLVHYAYRLWHYPCTVNYTLFKVRMYVGGVEHRLEVACNWTRGERCNLDDRDRSELSPLLLSTTQWQVLPCSFTTLPALTTGLIHLHQNIVDVQYLYGVGSSIVSWAVKWEYVILLFLLLADARICSCLWMMLLISQAEA

SEQ ID NO: 16 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVVDMVAGAHWGVLAGLAYYSMVGNWAKVLIVMLLFAGVDGGTYVTGGTMAKNTLGITSLFSPGSSQKIQLVNTNGSWHINRTALNCNDSLNTGFLAALFYVHKFNSSGCPERMASCSPIDAFAQGWGPITYNESHSSDQRPYCWHYAPRPCGIVPAAQVCGPVYCFTPSPVVVGTTDRFGVPTYSWGENETDVLLLNNTRPPQGNWFGCTWMNSTGFTKTCGGPPCNIGGIGNKTLTCPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEA

SEQ ID NO: 17 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGMGWAGWLLSPRGSRPSWGPTDPRRRSRNLGKVIDTLTCGFADLMGYIPLVGAPLGGVARALAHGVRVVEDGVNYATGNLPGCSFSIFLLALLSCLTIPASAYEVRNVSGIYHVTNDCSNSSIVYEAADMIMHTPGCVPCVREGNSSRCWVALTPTLAARNASVPTTAIRRHVDLLVGAAAFCSAMYVGDLCGSVFLVSQLFTFSPRRHETIQDCNCSIYPGHVSGHRMAWDMMMNWSPTTALVVSQLLRIPQAIVDMVAGAHWGVLAGLAYYSMVGNWAKVLIVMLLFAGVDGETRVTGGQIARNAYSLTTLFSSGSAQNIQLINTNGSWHINRTALNCNDSLNTGFLAALFYTHKFNASGCPERLASCRPIDKFDQGWGPITYAEQGGQDQRPYCWHYAPKPCGIVSASKVCGPVYCFTPSPVVVGTTDRFGVPTYSWGENETDVLLLNNTRPPQGNWFGCTWMNGTGFTKTCGGPPCNIGGGGNNTLTCPTDCFRKHPAATYTKCGSGPWLTPRCLVDYPYRLWHYPCTANFTIFKVRMYVGGVEHRLDAACNWTRGERCNLEDRDRLELSPLLLSTTEWQVLPCSFTTLPALSTGLIHLHQNIVDVQYLYGIGSAVVSFAIKWDYIVILFLLLADARVCACLWMMLLIAQAEA

SEQ ID NO: 18 - protein, 747 aa, Hepatitis C virus
MSTNPKPQRKTKRNTNRRPQDVKFPGGGQIVGGVYLLPRRGPRLGVRAIRKTSERSQPRGRRQPIPKARRPEGRAWAQPGYPWPLYGNEGMGWAGWLLSPRGSRPSWGPTDPRRRSRNLGKVIDTLTCGLADLMGYIPLVGGPLGGAARALAHGVRVLEDGVNYATGNLPGCSFSIFLLALLSCLTVPASAHEVRNASGVYHVTNDCSNSSIVFEAADLIMHTPGCVPCVREGNSSRCWVALTPTLAARNATIPTTTIRHHVDLLVGAAALCSAMYVGDLCGSVFLVSQLFTFSPRRHATLQDCNCSIYPGHASGHRMAWDMMMNWSPTTALVVSQLLRIPQAVIDMVAGAHWGVLAGLAYYSMAGNWAKVLIVMLLFAGVDGHTLTTGGHAARLTSGFAGLFTPGPSQRIQLINTNGSWHINRTALNCNDSLQTGFLAALFYAHRFNSSGCPERMASCRSIDKFDQGWGPITYAEPTKDPDQRPYCWHYPPQQCGIVPASQVCGPVYCFTPSPVVVGTTDRLGNPTYSWGENDTDVLLLNNTRPPQGNWFGCTWMNSTGFTKTCGAPPCNIGGVGNNTLTCPTDCFRKHPEATYSKCGSGPWLTPRCMVDYPYRLWHYPCTVNFSIFKVRMYVGGVEHRLNAACNWTRGERCNLDDRDRSELSPLLLSTTEWQVLPCSFTTLPALSTGLIHLHQNIVDVQYLYGIGSAVVSFAIKWEYVVLLFLLLADARVCACLWMMLLIAQAEA

SEQ ID NO: 19 - protein, 746 aa, Hepatitis C virus
MSTNPKPQRKTKRNTNRRPQDVKFPGGGQIVGGVYLLPRRGPRLGVRATRKTSERSQPRGRRQPIPKARHPEGRTWAQPGYPWPLYGNEGLGWAGWLLSPRGSRPSWGPTDPRRRSRNLGKVIDTLTCGFADLMGYIPLVGAPLGGVARALAHGVRVLEDGVNYATGNLPGCSFSIFLLALLSCLTIPASAYEVRNVSGVYHVTNDCSNSSIVYEAADVIMHTPGCVPCVQDGNTSRCWVALTPTLAARNASVPVTAIRRHVDLLVGTAAFCSAMYVGDLCGSVFPVSQLFTFSPRRHQTVQDCNCSIYPGHISGHRMAWDMMMNWSPTAALVVSQLLRIPQAIVDMVAGAHWGVLAGLAYYSMVGNWAKVMIVLLLFAGVDGTTHTTGGAAARATQGFTSFFSLGPSQKIQLINTNGSWHINRTALNCNDSLQTGFLAALFYTYRFNASGCPERMASCRPIDKFDQGWGPITYAEPDSSDQRPYCWHYAPRPCGIVPASQVCGPVYCFTPSPVVVGTTDRFGVPTYTWGENETDVLLLNNTRPPLGNWFGCTWMNSTGFTKTCGGPPCNIGGAGNTTLTCPTDCFRKHPEATYTKCGSGPWLTPRCLVDYPYRLWHYPCAVNFTIFKVRMYVGGVEHRLNAACNWTRGERCDLEDRDRSELSPLLLSTTEWQVLPCSFTTLPALSTGLIHLHQNIVDVQYLYGIGSAVIPFAIKWEYVLLLFLLLADARVCACLWMMLLIAQAEA

SEQ ID NO: 20 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGMGWAGWLLSPRGSRPNWGPTDPRRRSRNLGKVIDTLTCGFADLMGYIPLVGAPLGGVARALAHGVRVLEDGVNYATGNLPGCSFSIFLLALLSCLTTPASAYEVRNVSGIYHVTNDCSNSSIVYEAADIIMHTPGCVPCVREKNISRCWVALTPTLAARNISVPTATIRRHVDLLVGTAAFCSAMYVGDLCGSVFLVSQLFTFSPRWHETVQDCNCSLYPGHVSGHRMAWDMMMNWSPTAALVVSQLLRIPQAVVDMVAGAHWGVLAGLAYYSMIGNWAKVLIVMLLFAGADGTTHVTGGVQAHGAYGLASLFNVGPHQKIQLVNTNGSWHINRTALNCNDTLQTGFLAALFYKHRFNASGCPERMASCRPIDKFAQGWGPITYAEPDRLDQRPYCWHYPPRPCGIVPALEVCGPVYCFTPSPVVVGTTDRFGVPTYSWGENETDVLLLNNTRPPQGNWFGCTWMNSTGYTKTCGGPPCNIGGVGNNTLTCPTDCFRKHPEATYTKCGSGPWLTPRCLVHYPYRLWHYPCTVNFTIFKVRMYVGGIEHRLDAACNWTRGERCDLEDRDRSELSPLLLSTTEWQILPCSFTTLPALSTGLIHLHRNIVDVQYLYGIGSAVVSFAIKWEYVLLLFLLLADARVCACLWMMLLIAQAEA

SEQ ID NO: 21 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGLGWAGWLLSPRGSRPSWGPNDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHAPGCVPCVRENNSSRCWVALTPTLAARNASVPTTTLRRHVDLLVGTAAFCSAMYVGDLCGSVFLISQLFTFSPRRHETVQDCNCSIYPGHVSGHRMAWDMMMNWSPTAALVVSQLLRIPQAVMDMVAGAHWGVLAGLAYYSMVGNWAKVLIVMLLFAGVDGHTRVTGGVQGHVTSTLTSLFRPGASQKIQLVNTNGSWHINRTALNCNDSLKTGFLAALFYTHKFNASGCPERMASCRSIDKFDQGWGPITYAQPDNSDQRPYCWHYAPRQCGIVPASQVCGPVYCFTPSPVVVGTTDRFGAPTYNWGDNETDVLLLNNTRPPHGNWFGCTWMNSTGFTKTCGGPPCNIRGVGNNTLTCPTDCFRKHPDATYTKCGSGPWLTPRCLVDYPYRLWHYPCTVNFTIFKVRMYVGGVEHRLDAACNWTRGERCDLEDRDRAELSPLLLSTTEWQILPCSYTTLPALSTGLIHLHQNIVDIQYLYGIGSAVVSIAIKWEYVVLLFLLLADARVCACLWMMLLIAQAEA

SEQ ID NO: 22 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGDEGMGWAGWLLSPRGSRPNWGPTDPRRRSRNLGKVIDTLTCGFADLMGYIPLVGAPLGGVARALAHGVRVLEDGVNYATGNLPGCSFSIFLLALLSCLTTPASAYEVRNVSGIYHVTNDCSNSSIVYEAADIIMHTPGCVPCVREKNTSRCWVALTPTLAARNISVPTTTIRRHVDLLVGTAAFCSAMYVGDLCGSVFLVSQLFTFSPRRHETVQDCNCSLYPGHVSGHRMAWDMMMNWSPTAALVVSQLLRIPQAIVDMVAGAHWGVLAGLAYYSMVGNWAKVLIVMLLFAGADGTTHVTGGVQAHGAYGLASLFNVGPHQKIQLVNTNGSWHINRTALNCNDTLQTGFLAALFYKHRFNASGCPERMASCRPIDKFAQGWGPITYAEPDRLDQRPYCWHYPPRPCGIVPALEVCGPVYCFTPSPVVVGTTDRFGVPTYSWGENETDVLLLNNTRPPQGNWFGCTWMNNTGFTKTCGGPPCNIGGVGNNTLTCPTDCFRKHPEATYTKCGSGPWLTPRCLVDYPYRLWHYPCTVNFTVFKVRMYVGGIEHRLDAACNWTRGERCDLEDRDRSELSPLLLSTTEWQILPCSFTTLPALSTGLIHLHRNIVDVQYLYGIGSAVVSFAIKWEYILLLFLLLADARVCACLWMMLLIAQAEA

SEQ ID NO: 23 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVREDNSSRCWVALTPTLAARNSSVPTTTIRRHVDLLVGAAAFCSAMYVGDLCGSVFLISQLFTFSPRRYETVQDCNCSLYPGHVSGHRMAWDMMMNWSPTTALVVSQLLRIPQAVVDMVAGAHWGVLAGLAYYSMVGNWAKVLIVMLLFAGVDGNTRVSGGEAAKNTMGFASLFVSGPSQKIQLINTNGSWHINRTALNCDDSLHTGFLAALFYAHKFNSSGCSGRMASCRPIDEFAQGWGPITHGVPDNLDQRPYCWHYAPRPCGIVPASQVCGPVYCFTPSPVVVGTTDRFGAPTYSWGENETDVLLLNNTRPPQGNWFGCTWMNSTGFTKTCGGPPCNIGGVGNNTLTCPTDCFRKHPEATYTKCGSGPWLTPRCMVDYPYRLWHYPCTVNFTIFKVRMYVGGVEHRLDAACNWTRGERCNVEDRDRSELSPLLLSTTEWQILPCSFTTLPALSTGLIHLHQNIVDVQYLYGVGSVVVSVVIRWEYVVLLFLLLADARVCACLWMMLLIAQAEA

SEQ ID NO: 24 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGMYHVTNDCSNSSIVYEAADMILHAPGCVPCVRENNSSRCWVALTPTLAARNASVPTTAIRRHVDLLVGAAAFCSAMYVGDLCGSVLLVSQIFTFSPRRHETMQDCNCSIYPGHITGHRMAWDMMMNWSPTTALVVSQLLRIPQAIVDMVAGAHWGVLAGLAYYSMVGNWAKVLIVMLLFAGVDGGTYVTGGEAGRRTSGFASIFTPGASQNIQLINTNGSWHINRTALNCNDSLHTGFIAALFYHHKFNASGCPERMASCRPIGEFAQGWGPISYTEPPSSDQRPYCWHYPPRPCGIVPASQVCGPVYCFTPSPVVVGTTDRLGAPTYNWGDNDTDVLLLNNTRPPQGNWFGCTWMNGTGFTKTCGGPPCNIGGVGNNTLTCPTDCFRKHPEATYTKCGSGPWLTPRCIVDYPYRLWHYPCTVNFTITKIRMYVGGVEHRLTAACNWTRGERCDLEDRDRSELSPLLLSTTEWQIMPCSFTTLPALSTGLIHLHQNIVDIQYLYGIGSAAVSFAIRWEYVLLLFLLLADARVCACLWMMLLIAQAEA

SEQ ID NO: 25 - protein, 746 aa, Hepatitis C virus; identical to SEQ ID NO: 24

SEQ ID NO: 26 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGTARALAHGVRVLEDGVNYATGNLPGCSFSIFLLALLSCLTIPASAYEVRNVSGVYHVTNDCSNSSIVYETADMIMHTPGCVPCVREDNFTRCWVALTPTLAARNGSVPTTAIRRHVDLLVGAAAFCSAMYVGDLCGSVFLVSQLFTFSPRWHETVQECNCSIYPGHVTGHRMAWDMMMNWSPTTALVVSQLLRIPQAVVDMVAGAHWGVLAGLAYYSMVGNWAKVLIVTLLFAGVDGNTHTIGGKQAQATGGFVAWLARGPSQEIQLINTNGSWHINRTALNCNDSLKTGFIAALFYAHRFNSSGCPERMASCRPIDKFAQGWGPITYAKPDSLDQRPYCWHYAPQPCGIVPASEVCGPVYCFTPSPVVVGTTDRSGVPTYRWGENETDVLLLNNTRPPQGNWFGCTWMNATGFTKTCGGPPCKIGGLGNNTLTCPTDCFRKHPEATYTKCGSGPWLTPRCIVDYPYRLWHYPCTVNFTIFKVRMYVGGIEHRLSAACNWTRGERCDLEDRDRSELSPLLLSTTEWQILPCSFTTLPALSTGLIHLHQNTVDVQYLYGVGSVLVSFAIKWEYILLFFLLLADARVCACLWMMLLIAQAEA

SEQ ID NO: 27 - protein, 746 aa, Hepatitis C virus
MSTNPKPQRKTKRNTNRRPQNVKFPGGGQIVGGVCLLPRRGPRVGVRATRKTSERSQPRGRRQPIPKARRPEGRSWAQPGYPWPLYGNEGCGWAGWLLSPRGSRPSRGPSDPRRRSRNLGKVIDTLTCGFADLMGYIPLVGAPLGGAARALAHGVRVLEDGVNYATGNLPGCSFSIFLLALLSCLTVPASAVEVRNSSGIYHVTNDCPNASVVYETDSLIIHLPGCVPCVREGNASRCWVSLSPTVAAKDPGVPVNEIRRHVDLIVGAAAFCSAMYVGDLCGSIFLVGQLFTLSPRRHWTTQDCNCSIYPGHVTGHRMAWDMMMNWSPTGALVVAQLLRIPQAVLDMIAGAHWGVLAGPAYYSMVGNWAKVLVVLLLFAGVDATTQVTGGTAGRNAYRLASLFSTGPSQNIQLINSNGSWHINRTALNCNDSLHTGWVAALFYSHKFNSSGRPERMASCRPLTAFDQGWGPITYGGKASNDQRPYCWHYAPRPCGIVPAKEVCGPVYCFTPSPVVVGTTDKYGVPTYTWGENETDVLLLNNSRPPIGNWFGCTWMNSTGFTKTCGAPACNVGGSETNTLSCPTDCFRRHPDATYAKCGSGPWLNPRCMVDYPYRLWHYPCTVNYTIFKIRMFVGGIEHRLTAACNWTRGERCDLDDRDRAELSPLLLSTTQWQVLPCSFTTLPALSTGLIHLHQNIVDVQYLYGLSSVVTSWAIRWEYVVLLFLLLADARICACLWMMLLISQVEA

SEQ ID NO: 28 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTYGFADLMGYIPLVGAPLGGAARALAHGVRVLEDGVNYATGNLPGCSFSIFLLALLSCLTVPASAVGVRNSSGVYHVTNDCPNASVVYETDSLIIHLPGCVPCVREGNGSRCWVSLSPTVAAKDPGVPVNEIRRHVDLIAGAAAFCSAMYVGHLCGSIFLVGQLFTLSPRRHWTTQDCNCSIYPGHVTGHRMAWDMMMNWSPTTALVVAQLLRIPQAILDMIAGAHWGVLAGIAYFSMVGNWTKVLVVLLLFAGVDATTIVSGGSAGRSTAGLVGLFSPGARQNIQLINTNGSWHINRTALNCNDTLQTGWVAGLFYTNKFNSSGCPERLASCRPLADFDQGWGPISYTNGSGPDQRPYCWHYPPKPCGIVPAESVCGPVYCFTPSPVVVGTTDRSGAPTYNWGENETDVFVLNNTRPRLGNWFGGTWMNSTGFTKVCGAPPCAIGGVGNNTLYCPTDCFRKHPEATYSRCGSGPWITPRCLIHYPYRLWHYPCTINYTIFKIRMFVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEA

SEQ ID NO: 29 - protein, 746 aa, Hepatitis C virus
MSTNPKPQRKTKRNTNRRPQDVKFPGGGQIVGGVYLLPRRGPRVGVRATRKTSERSQPRGRRQPIPKARRPEGRSWAQPGYPWPLYGNEGCGWAGWLLSPRGSRPSWGPSDPRRRSRNLGKVIDTLTCGFADLMGYIPLVGAPLGGAARALAHGVRVLEDGVNYATGNLPGCSFSIFLLALLSCLTVPASAVGVRNSSGVYHVTNDCPNASVVYETENLIMHLPGCVPYVREGNASRCWVSLSPTVAARDSRVPVSEVRRRVDSIVGAAAFCSAMYVGDLCGSIFLVGQIFTFSPRHHWTTQDCNCSIYPGHVTGHRMAWDMMMNWSPTGALVVAQLLRIPQAIVDMIAGAHWGVLAGLAYYSMVGNWAKVVVVLLLFAGVDAETRVTGGAAGHTAFGFASFLAPGAKQKIQLINTNGSWHINRTALNCNESLDTGWLAGLLYYHKFNSSGCPERMASCQPLTAFDQGWGPITHEGNASDDQRPYCWHYALRPCGIVPAKKVCGPVYCFTPSPVVVGTTDRAGVPTYRWGANETDVLLLNNSRPPMGNWFGCTWMNSSGFTKTCGAPACNIGGSGNNTLLCPTDCFRKHPDATYSRCGSGPWLTPRCLVDYPYRLWHYPCTVNYTIFKIRMFVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEA

SEQ ID NO: 30 - protein, 750 aa, Artificial Sequence
  Synthetic Sequence
  misc_feature (233)..(233): Xaa can be any amino acid
  misc_feature (249)..(250): Xaa can be any amino acid
  misc_feature (290)..(290): Xaa can be any amino acid
  misc_feature (378)..(378): Xaa can be any amino acid
  misc_feature (392)..(392): Xaa can be any amino acid
  misc_feature (399)..(399): Xaa can be any amino acid
  misc_feature (445)..(445): Xaa can be any amino acid
  misc_feature (495)..(495): Xaa can be any amino acid
  misc_feature (599)..(599): Xaa can be any amino acid
  misc_feature (628)..(628): Xaa can be any amino acid
  misc_feature (664)..(664): Xaa can be any amino acid
  misc_feature (683)..(683): Xaa can be any amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAVEVKNISTSYMVTNDCSNDSITWQLQAAVLHVPGCVPCENDXNTSRCWIPVSPNVAVXXPGALTQGLRTHIDMVVMSATLCSALYVGDLCGGVMLAAQXFIVSPQRHWFVQECNCSIYPGTITGHRMAWDMMMNWSPTATMILAYAMRVPEVIIDIIFGAHWGVMFGLAYFSMQGAWAKVIVILLLXAGVDARTHTVGGSXGRTTSGXAGLFSSGPKQNIQLINTNGSWHINRTALNCNDSLQTGFIASLFYTXNFNSSGCPERLSACRGIEAFRIGWGTLQYEDNVTNPEDMRPYCWHYPPKXCGIVPARSVCGPVYCFTPSPVVVGTTDRLGVPTYTWGENETDVFLLNSTRPPRGSWFGCTWMNSTGFTKTCGAPPCRIRADFNASTDLLCPTDCFRKHPDATYXKCGSGPWLTPRCLVDYPYRLWHYPCTVNXTIFKIRMYVGGVEHRLTAACNFTRGDRCNLEDRDRXQLSPLLHSTTEWAILPCSXSDLPALSTGLLHLHQNIVDVQYMYGLSPALTKYIVRWEWVVLLFLLLADARVCACLWMLILLGQAEA

SEQ ID NO: 31 - protein, 750 aa, Hepatitis C virus
MSTNPKPQRKTKRNTNRRPEDVKFPGGGQIVGGVYLLPRRGPRLGVRTTRKTSERSQPRGRRQPIPKDRRSTGKAWGKPGRPWPLYGNEGLGWAGWLLSPRGSRPSWGPTDPRHRSRNVGKVIDTLTCGFADLMGYIPVVGAPLSGAARAVAHGVRVLEDGVNYATGNLPGFPFSIFLLALLSCITVPVSAAQVKNTSSSYMVTNDCSNDSITWQLEAAVLHVPGCVPCERVGNTSRCWVPVSPNMAVRQPGALTQGLRTHIDMVVMSATFCSALYVGDLCGGVMLAAQVFIVSPQYHWFVQECNCSIYPGTITGHRMAWDMMMNWSPTATMILAYVMRVPEVIIDIVSGAHWGVMFGLAYFSMQGAWAKVIVILLLAAGVDAGTTTVGGAVARSTNVIAGVFSHGPQQNIQLINTNGSWHINRTALNCNDSLNTGFLAALFYTNRFNSSGCPGRLSACRNIEAFRIGWGTLQYEDNVTNPEDMRPYCWHYPPKPCGVVPARSVCGPVYCFTPSPVVVGTTDRRGVPTYTWGENETDVFLLNSTRPPQGSWFGCTWMNSTGFTKTCGAPPCRTRADFNASTDLLCPTDCFRKHPDATYIKCGSGPWLTPKCLVHYPYRLWHYPCTVNFTIFKIRMYVGGVEHRLTAACNFTRGDRCDLEDRDRSQLSPLLHSTTEWAILPCTYSDLPALSTGLLHLHQNIVDVQYMYGLSPAITKYVVRWEWVVLLFLLLADARVCACLWMLILLGQAEA

SEQ ID NO: 32 - protein, 749 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITTPVSAAQVKNTSDIYMVTNDCSNDSITWQLQAAALHVPGCVPCERVGNTSRCWIPVSPNVAVRQPGALTQGLRTHIDMVVMSATLCSALYVGDLCGGVMLAAQMFIISPQHHWFVQECNCSIYPGTITGHRMAWDMMMNWSPTTTMILAYVMRVPEVIIDIIGGAHWGVMFGLAYFSMQGAWAKVVVILLLAAGVDAHTRTGSSVGYATSGIVGLFTSGPKQNIQLINTNGSWHINRTALNCNDSLNTGFIVSLFYARNFNSTGCPERLSACRGIEGFRIGWGTLQYEDNVTNPEDMRPYCWHYPPKQCGIVPAGSVCGPVYCFTPSPVVVGTTDRLGVPTYTWGENETDVFLLNSTRPPVGSWFGCTWMNSTGFTKTCGAPPCRIRADFNASTDLLCPTDCFRKHPEATYIKCGSGPWLTPRCLVDYPYRLWHYPCTVNYSIFKIRMYVGGVEHRLTAACNFTRGDRCNLEDRDRSQLTPLLHSTTEWAILPCTYSDLPALSTGLLHLHQNIVDVQYMYGLSPALTKYVVRWEWVVLLFLLLADARVCACVWMLILLGQAEA

SEQ ID NO: 33 - protein, 750 aa, Hepatitis C virus
  misc_feature (458)..(458): Xaa can be any amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCVTVPVSAVQVKNTSETYMVTNDCSNDSITWQLQAAVLHVPGCVPCERTGNTSRCWIPVSPNVAVQQPGALTQGLRTHIDMVVMSATLCSALYVGDLCGGVVLAAQLFIVSPRRHWFVQECNCSIYPGAITGHRMAWDMMMNWSPTTTMVLAYAMRVPEVIIDIISGAHWGVMFGLAYFSMQGAWAKVAVILLLTAGVEARTHTTGSVAGRTTSGFAGIFTSGPKQNIQLINTNGSWHINRTALNCNDSLNTGFMAALFYTKNFNSSGCPERLSXCRNIEAFRIGWGTLQYEDDVTNPEDMRPYCWHYPPKQCGIFPAGSVCGPVYCFTPSPVVVGTTNKLGVPTYTWGENETDVFILNSTRPPRGSWFGCTWMNSTGFTKTCGAPPCRIRADFNASTDLLCPTDCFRKHPEATYIKCGSGPWLTPRCLVDYPYRLWHYPCTVNYSIFKIRMYVGGVEHRLTAACNFSRGDRCNLEDRDRSQLTPLLHSTTEWAILPCSYSDLPALSTGLLHLHQNIVDVQYMYGLTPALTKYVVRWEWVVLLFLLLADARVCACLWMLILLGQAEA

SEQ ID NO: 34 - protein, 750 aa, Hepatitis C virus
MSTNPKPQRKTKRNTSRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAVQVKNISDSYMVTNDCSNDSITWQLQAAVLHVPGCVPCEKMGNISRCWIPVSPNVAVQRPGALTQGLRAHIDMVVMSATLCSALYVGDLCGGVMLAAQMFIVSPQHHHFVQECNCSIYPGAITGHRMAWDMMMNWSPTATMILAYAMRVPEVIIDIISGAHWGVMFGLAYFSMQGAWAKVVVILLLTAGVDAHTRSIAGSVAHATSGLAGLFTSGAKQNIQLINTNGSWHINRTALNCNDSLNTGFIASLFYTYRFNSSGCPERLSACRGIQAFRIGWGTLRYEDNVTNPEDMRPYCWHYPPKQCGIVSARSVCGPVYCFTPSPVVVGTTDRLGVPTYTWGENETDVFILNSTRPPGGSWFGCTWMNSTGFTKTCGAPPCRIRADFNASMDLLCPTDCFRKHPDATYIKCGSGPWLTPRCLVDYPYRLWHYPCTINYTIFKIRMYVGGVEHRLTAACNFTRGDPCNLEDRDRSQLSPLLHSTTEWAILPCSYSDLPALSTGLLHLHQNIVDVQYMYGLSPALTKYIVRWEWVVLLFLLLADARVCACLWMLILLGQAEA

SEQ ID NO: 35 - protein, 751 aa, Hepatitis C virus
MSTNPKPQRKTQRNTNRRPQDVKFPGGGQIVGGVYLLPRRGPRLGVRTARKTSERSQPRGRRQPIPKDRRSTGKSWGRPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITIPASAVEVKNTSTGYMVTNDCANSSITWQLHAAVLHVPGCVPCERVDNNTSRCWIPVSPNIAVQRPGALTQGLRSHIDIVVMSATLCSALYVGDLCGGVMLAAQMFVVSPEHHWFVQECNCSIYPGTITGHRMAWDMMMNWSPTATMILAYAMRVPEVIIDIIGGAHWGVMFGLAYFSMQGAWAKVVVILLLAAGVDAYTHTVGGAAASTANSIAGLLSRGPRQNLQLINSNGSWHINRTALNCHDSLQTGFITALFYARHFNSSGCPERLAACRNIEAFRVGWGALQYEDNVTNPEDMRPYCWHYPPKQCGIVPARSVCGPVYCFTPSPVVVGTTDKLGVPTYTWGENETDVFLLNSTRPPQGPWFGCTWMNSTGFTKTCGAPPCRTRADFNASTDLLCPTDCFRKHPDATYNKCGSGPWLTPRCLIDYPYRLWHYPCTVNYTTFKIRMYVGGVEHRLMAACNFTRGDSCDLSQRDRGQLSPLLHSTTEWAILPCSFSDLPALSTGLLHLHQNIVDVQYMYGLSPALTKYIVRWEWVVLLFLLLADARVCACIWMLILLGQAEA

SEQ ID NO: 36 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNTSRCWIPVSPNVAVQQPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIIGGAHWGVMFGLAYFSMQGAWAKVVVILLLAAGVDAQTHTVGGSTAHNARTLTGMFSLGARQKIQLINTNGSWHINRTALNCNDSLHTGFLASLFYTHSFNSSGCPERMSACRSIEAFRVGWGALQYEDNVTNPEDMRPYCWHYPPRQCGVVSASSVCGPVYCFTPSPVVVGTTDRLGAPTYTWGENETDVFLLNSTRPPQGSWFGCTWMNSTGYTKTCGAPPCRIRADFNASMDLLCPTDCFRKHPDTTYIKCGSGPWLTPRCLIDYPYRLWHYPCTVNYTIFKIRMYVGGVEHRLTAACNFTRGDRCNLEDRDRSQLSPLLHSTTEWAILPCTYSDLPALSTGLLHLHQNIVDVQFMYGLSPALTKYIVRWEWVVLLFLLLADARVCACLWMLILLGQAEA

SEQ ID NO: 37 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEA

SEQ ID NO: 38 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLSWSPTLTMILAYAARVPELVLEIIFGGHWGVVFGLAYFSMQGAWAKVIAILLLVAGVDATTYSSGQEAGRTVAGFAGLFTTGAKQNLYLINTNGSWHINRTALNCNDSLQTGFLASLFYTHKFNSSGCPERLSSCRGLDDFRIGWGTLEYETNVTNDGDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEA

SEQ ID NO: 39 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPHWGPTDPRHRSRNLGKVIDTITCGFADLMGYIPVIGAPVGGVARALAHGVRVLEDGVNYATGNLPGCSFSIFLLALLSCVTVPVSAVEVRNISSSYYATNDCSNNSITWQLENAVLHLPGCVPCENDNGTLRCWTQVTPNVAVKHRGALTQNLRTHVDVIVVAATVCSALYVGDVCGAVMIASQALIVSPARHNFTQECNCSIYQGRITGHHMAWDMMLNWSPTITMILAYAARIPELVLEVIFGGHWGVMFGLAYFSMQGAWAKVIVILLLVAGVDARHHTTGLQAGKTLARVTSLFSIGAKQNIQLINTNGSWHINRTALNCNDSLQTGFIASLFYVNNINSSGCPERMSSCRELDDFRIGWGTLEYETNVTNDEDMRPYCWHYPPKPCGIVPARTVCGPVYCFTPSPIVVGTTDKQGVPTYSWGENETDVFLLNSTRPPRGSWFGCTWMNGTGFTKTCGAPPCRIRRDYNSTLDLLCPTDCFRKHPDTTYLKCGSGPWLTPKCLVEYPYRLWHYPCTVNFTIFKVRMYVGAVEHRFSAACNFTRGDRCRLEDRDRGQQSPLLHSTTEWAVLPCSFSDLPALSTGLLHLHQNIVDVQYLYGLSPAITRYIVKWEWVVLLFLLLADARVCACLWMLIILGQAEA

SEQ ID NO: 40 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCCTVPVSAVEVRNISTSYYATNDCSNTSITWQLTNAVLHLPGCVPCENDNGTLRCWIQVTPNVAVKHRGALTHNLRTHVDVIVMAATVCSALYVGDICGAVMIVSQAFIISPERHNFTQECNCSMYQGHITGHRMAWDMMLNWSPTLTMILAYAARVPELVLEVIFGGHWGVVFGLAYFSMQGAWAKVIAILLLVAGVDANTYSSGVTVGHTTSTFANIFSVGPSQKINLINTNGSWHINRTALNCNDSLQTGFLASLFYVRNFNSSGCRERLSSCRRLDDFRIGWGTLEYETNVTNDEDMRPYCWHYPPKPCGIVSARTVCGPVYCFTPSPVVVGTTDRQGVPTYSWGENETDVFLLNSTRPPRGAWFGCTWMNGTGFTKTCGAPPCRIRRDYNSTLDLLCPTDCFRKHPDTTYLKCGAGPWLTPKCLVDYPYRLWHYPCTVNFTIFKVRMYVGGVEHRLSAACNFTRGDRCGLEDRDRGQQSPLLHSTTEWAVLPCSFSDLPALSTGLLHLHQNIVDVQYLYGLSPAITRYIVKWEWVVLLFLLLADARVCACLWMLIILGQAEA

SEQ ID NO: 41 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPSDPRHRSRNLGRVIDTITCGFADLMGYIPVVGAPVGGVARALAHGVRVLEDGINYATRNLPGCSFSIFLLALLSCVTVPVSSVEIRNISTSYYATNDCSNNSITWQLTNAVLHLPGCVPCENDNGTLRCWIQVTPNVAVKHRGALTHNLRAHVDVIVMAATVCSALYVGDVCGAVMIVSQALIVSPERHNFTQECNCSIYQGHITGQRMAWDMMLNWSPTLTMILAYAARVPELVLEIVFGGHWGVVFGLAYFSMQGAWAKVIAILLLVAGVDATTYSTGATVGRTVGSFAGLFKLGAQQNVQLINTNGSWHINRTALNCNDSLHTGFMAALFYANKFNSSGCPERLSSCRGLDDFRIGWGTLEYETNVTNVEDMRPYCWHYPPKPCGIVPAQSVCGPVYCFTPSPVVVGTTDRQGVPTYNWGDNETDVFLLNSTRPPRGAWFGCTWMNGTGFTKTCGAPPCRIRKDFNSTLDLLCPTDCFRKHPDATYVKCGAGPWLTPRCLIDYPYRLWHYPCTVNFTIFKVRMYVGGVEHRFSAACNFTRGDRCRLEDRDRGQQSPLLHSTTEWAVLPCSFSDLPALSTGLLHLHQNIVDVQYLYGLSPAVTKYIVKWEWVVLLFLLLADARICACLWMLIILGQAEA

SEQ ID NO: 42 - protein, 750 aa, Hepatitis C virus
  misc_feature (203)..(203): Xaa can be any amino acid
  misc_feature (295)..(295): Xaa can be any amino acid
  misc_feature (343)..(343): Xaa can be any amino acid
  misc_feature (401)..(401): Xaa can be any amino acid
  misc_feature (426)..(426): Xaa can be any amino acid
  misc_feature (626)..(626): Xaa can be any amino acid
MSTDPKPQRKTKRNTNRRPQDVKFPGGGQIVGGVYLLPRRGPRLGVRAARKTSERSQPRGRRQPIPKDRRSPGKSWGKPGYPWPLYGNEGCGWAGWLLSPRGSRPTWGPTDPRHRSRNLGKVIDTITCGFADLMGYIPVVGAPVGGVARALAHGVRVLEDGINYATGNLPGCSFSIFLLALLSCLTVPASAVEVRNISSGYYXTNDCSNSSITWQLTNAVLHLPGCVPCENDNGTLRCWIQVTPNVAVKYRGALTHNLRTHVDMIVMAATVCSALYVGDVCGAVMIVSQAFIMSXERHNFTQECNCSIYQGHITGHRMAWDMMLGWSPTLTMILAYAARVPEXVLEVVFGGHWGVVFGLAYFSMQGAWAKVIAILLLVAGVDAGTYSSGATIGQGTRGLVXLFSAGPSQKISLINTNGSWHINRTXLNCNDSLQTGFIASLFYAKSFNSSGCPERLSSCRGLDDFRIGWGTLEYENNVTNDEDMRPYCWHYPPKPCGIVPARTVCGPVYCFTPSPVVVGTTDKQGVPTYSWGENETDVFLLNSTRPPQGAWFGCTWMNGTGFTKTCGAPPCRIRRDHTSTLDLLCPTDCFRKHPDTTYLKCGAGPWLTPKCLVDYPYRLWHYPCTXNFTIFKVRMYVGGVEHRFSAACNFTRGDRCRLEDRDRGQQSPLLHSTTEWAVLPCSFSDLPALSTGLLHLHQNIVDVQYLYGLSPAITKYIVKWEWVILLFLLLADARVCACLWMLIILGQAEA

SEQ ID NO: 43 - protein, 752 aa, Hepatitis C virus
  misc_feature (431)..(431): Xaa can be any amino acid
  misc_feature (466)..(466): Xaa can be any amino acid
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDATTYTTGGSAARGARGLTSLFSVGAKQKLQLVNTNGSWHINSTALNCNXSINTGFIAGLFYYHKFNSTGCPQRLSSCKPITFFXQGWGPLTDANITGPSDDKPYCWHYAPRPCDVVPASSVCGPVYCFTPSPVVVGTTDAKGVPTYTWGENETDVFLLESLRPPSGRWFGCTWMNSTGFVKTCGAPPCNIYGGGGNPHNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEA

SEQ ID NO: 44 - protein, 752 aa, Hepatitis C virus
MSTLPKPQRKTKRNTIRRPQDVKFPGGGQIVGGVYVLPRRGPRLGVRATRKTSERSQPRERRQPIPKARRSDGRSWAQPGYPWPLYGNEGCGWAGWLLSPRGSRPSWGPNDPRRRSRNLGKVIDTLTCGFADLMGYIPIVGAPVGGVARALAHGVRALEDGINFATGNLPGCSFSIFLLALLSCLIHPAASLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETHTTGGTAARNAFTLTGLFTQGARQKLELINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESDLFCPTDCFRKHPEATYSRCGAGPWLTPRCLVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGVVGWALRWEFVVLVFLLLADARVCVALWLMLMISQAEA

SEQ ID NO: 45 - protein, 752 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEA

SEQ ID NO: 46 - protein, 752 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIMAGAHWGILAGLAYYSMQGNWAKVAIIMVMFSGVDAHTYTTGGTASRHTQAFAGLFDIGPQQKLQLVNTNGSWHINSTALNCNESINTGFIAGLFYYHKFNSTGCPQRLSSCKPITFFRQGWGPLTDANITGPSDDRPYCWHYAPRPCDIVPASSVCGPVYCFTPSPVVVGTTDARGVPTYTWGENEKDVFLLKSQRPPSGRWFGCSWMNSTGFLKTCGAPPCNIYGGEGNPHNESDLFCPTDCFRKHPETTYSRCGAGPWLTPRCMVDYPYRLWHYPCTVDFRLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQTEA

SEQ ID NO: 47 - protein, 752 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGQNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVSHVLRLPQTLFDIIAGAHWGILAGLAYYSMQGNWAKVAVIMVMFSGVDAETYITGGSAAHGVSTLTSLFSSGPQQKLQLVKTNGSWHINSTALNCNESINTGFIAGLFYYHKFNSTGCPQRLSSCKPITFFRQGWGSLTDANVTGASADKPYCWHYAPRPCDVVPALNVCGPVYCFTPSPVVVGTTDRKGVPTYNWGENESDVFLLESLRPPSGRWFGCAWMNSTGFLKTCGAPPCNIYGGGGNPNNESHLFCPTDCFRKHPDATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGMVGWALKWEFVILIFLLLADARVCVALWLMLMISQAEA

SEQ ID NO: 48 - protein, 752 aa, Hepatitis C virus
MSTLPKPQRKTKRNTIRRPQDVKFPGGGQIVGGVYVLPRRGPRLGVCATRKTSERSQPRRRRQPIPKARQSGGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQNDNISTCWTPVTPTVAVRYVGATTASIRSHVDLLVGAATMCSALYVGDMCGAVFLVGQAFTFRPRRHQTVQTCNCSLYPGHLSGHRMAWDMMMNWFPALGMAVAHVLRVPQTLFDIIAGAHWGILAGLAYYSMQGNWAKVAIIMVMFSGVDAVTYTTGGSAAHATRGLTSLFSVGAQQKLQLVNTNGSWHINSTALNCNESINTGFIAGLFYYHRFNSTGCPQRLSSCKPITFFKQGWGPLTDANISGPSDDKPYCWHYAPRPCKVVPASGVCGPVYCFTPSPVVVGTTDAKGVPTYTWGANDTDVFLLESLRPPGGRWFGCTWMNSTGFVKTCGASPCDIYGGGGNSGNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILIFLLLADRRVCVALWLMLMITQAEA

SEQ ID NO: 49 - protein, 752 aa, Hepatitis C virus
MSTLPKPQRKTKRNTVCRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNVSGLYILTNDCPNSSIVYEADDVILHTPGCIPCVQDGNTSTCWTALTPTVAVRYVGATTASIRSHVDLLVGAATMCSALYVGDMCGAVFLVGQAFTFRPRRHQTVQTCNCSLYPGHLTGHRMAWDMMMNWSPAVGMVVAHVLRLPQTLFDIIAGAHWGILAGLAYYSMQGNWAKVIIIMVMFSGVDATTHVTGGTAGLTAFRLTGLFTVGPQQKLQLVNTNGSWHINRTALNCNDSLNTGFIAGLFRFHKFNSTGCPEMLSSCKPITSFKQGWGPLTDANITIPSDDRPYCWHYPPRSCEVVPALSVCGPVYCFTPSPVVVGTTDAKGVPTYTWGENETDVFLLKSLRPPGGRWFGCTWMNSTGFVQTCGAPPCNIYGGGGDLKNESDLFCPTDCFRKHPEATYSRCGAGPWLTPRCMVDYPYRLWHYPCTVNFTLFKVRMFVGGFEHRFTAACNWTRGERCDIEDRDRSELHPLLHSTTELAILPCSFTPMPALSTGLIHLHQNIVDVQYLYGVGSGMVGWAVKWEFVILVFLLLADARVCVALWLMLMISQAEA

SEQ ID NO: 50 - protein, 752 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLQWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAAGMVVAHILRLPQTLFDIIAGAHWGILAGLAYYSMQGNWAKVAIIMVMFSGVDATTYTSGGSVAQQARGLADLFSVGAKQNLQLVNTNGSWHINSTALNCDDSINTGFIAGLFYYHKFNSTGCPQRLSDCKPITFFKQGWGPLTDANITGPSDDKPYCWHYAPRRCGVVPASSVCGPVYCFTPSPVVVGTTDAKGVPTYTWGANETDVFLLESLRPPSGRWFGCAWMNSTGFLKTCGAPPCNIYGGGGNPHNESDLFCPTDCFRKHPEATYSRCGAGPWLTPRCMVDYPYRLWHYPCTVNFTLFKMRTFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEA

SEQ ID NO: 51 - protein, 752 aa, Hepatitis C virus; identical to SEQ ID NO: 50

SEQ ID NO: 52 - protein, 752 aa, Hepatitis C virus
MSTLPKPQRKTKRNTIRRPQDVKFPGGGQIVGGVYVLPRRGPRLGVCATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCPNSSIVYEADDVILHTPGCIPCVQDGNKSTCWTSVTPTVAVKYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDATTYTTGGNAARGASGIVSLFTPGAKQNLQLVNTNGSWHINRTALNCNDSINTGFIAGLIYYHKFNSTGCPQRLSSCKPITFFRQGWGSLTDANITGPSDDKPYCWHYPPRPCDTIRASSVCGPVYCFTPSPVVVGTTDAKGAPTYNWGANETDMFLLQSLRPPSGRWFGCTWMNSTGFTKTCGAPPCNIYGGGGNLNNESDLFCPTDCFRKHPEATYSRCGAGPWLTPRCLVDYPYRLWHYPCTVNFTLFRMRTFVGGFEHRFTAACNWTRGERCNIEDRDRSEQHPLLHSTTELAILPCSFTPMPALSTGLIHLHQNIVDVQYLYGIGSGVVGWALKWEFVILVFLLLADARVCVALWLMLMISQAEA

SEQ ID NO: 53 - protein, 752 aa, Hepatitis C virus
MSTLPKPQRKTKRNTIRRPQDVKFPGGGVIYVGVYVLPRRGPRLGVRATRKTSERSQPRGRRKPIPKARRSEGRSWAQPGYPWPLYGNEGCGWAGWLLSPRGSRPNWAPNDPRRRSRNLGKVIDTLTCGFADLMGYIPLVGAPLGGAARALAHGVRALEDGINFATGNLPGCSFSIFLLALFSCLIHPAASLEWRNTSGLYVLTNDCSNSSIVYEADDVILHTPGCIPCVQDGNTSTCWTPVTPTVAVRYVGATTASIRSHVDLLVGAGTMCSALYVGDMCGPVFLVGQAFTFRPRRHRTVQTCNCSLYPGHLSGQRMAWDMMMNWSPAVGMVVAHILRLPQTLFDVVAGAHWGIIAGLAYYSMQGNWAKVAIIMVMFSGVDASTHVTAGQAARNAYGITSLFSVGAKQNLQLINTNGSWHINRTALNCNESINTGFIAGLFYYHKFNSTGCPQRLSSCKPITFFKQGWGPLTDANITGPSDDKPYCWHYAPRPCGIVPALNVCGPVYCFTPSPVVVGTTDAKGAPTYTWGANKTDVFLLESLRPPSGRWFGCTWMNSTGFVKTCGAPPCNIYGDGRDAQNESDLFCPTDCFRKHPEATYSRCGAGPWLTPRCLVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGIGSGMVGWALKWEFVILIFLLLADARVCVALWLILTISQAEA

SEQ ID NO: 54 - protein, 754 aa, Hepatitis C virus
MSTLPKPKRQTKRNTLRRPKNVKFPAGGQIVGEVYVLPRRGPQLGVREVRKTSERSQPRGRRQPTPKARPREGRSWAQPGYPWPLYGNEGCGWAGWLLPPRGSRPSWGQNDPRRRSRNLGKVIDTLTCGFADLMGYIPLIGAPVGGVARALAHGVRALEDGVNYATGNLPGCSFSIFLLALFSCLTCPASSLEYRNASGLYLLTNDCSNRSIVYEADDVILHLPGCVPCVETDNNNTSCWTPISPTVAVKHPGVTTASIRNHVNMLVAPPTLCSALYVEDAFGAVSLVGQAFTFRPRQHKTVQTCNCSIYPGHVSGHRMAWDMMMNWSPAIGLVISHLMRLPQTFFDLVVGAHWGVMAGLAYFSMQGNWAKVVIVLIMFSGVDATTHTTGGSAAQATAGFTSFFTRGPSQNLQLVNSNGSWHINSTALNCNDSLNTGFIAGLFYYHKFNSSGCPERMSSCKPITYFNQGWGPLTDANINGPSEDRPYCWHYPPRPCNITKPLNVCGPVYCFTPSPVVVGTTDIKGLPTYRFGVNESDVFLLTSLRPPQGRWFGCVWMNSTGFVKTCGAPPCNIYGGMKDIEANQTHLKCPTDCFRKHHDATFTRCGSGPWLTPRCLVDYPYRLWHYPCTVNFSIFKVRMFVGGHEHRFSAACNWTRGERCDLEDRDRSEQQPLLHSTTDSLILPCSFTPMRRLSTGLIHLHQNIVDVQYLYGVGSAVVGWALKWEFVVLVFLLLADARVCVALWMMLLISQAEA

SEQ ID NO: 55 - protein, 750 aa, Hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEA

SEQ ID NO: 56 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 325 aa, Homo sapiens
STKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 58 - protein, 246 aa, Homo sapiens
HKPSNTKVDKRVELKTPLGDTTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 383 aa, Homo sapiens
PTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPRSTTFWAWSVLRVPAPPSPQPATYTCVVSHEDSRTLLNASRSLEVSYVTDHGPMK

SEQ ID NO: 60 - protein, 276 aa, Homo sapiens
VTSTLTIKZSDWLGESMFTCRVDHRGLTFQQNASSMCVPDQDTAIRVFAIPPSFASIFLTKSTKLTCLVTDLTTYBSVTISWTREENGAVKTHTNISESHPNATFSAVGEASICEDBDWSGERFTCTVTHTDLPSPLKQTISRPKGVALHRPBVYLLPPARZZLNLRESATITCLVTGFSPADVFVEWMQRGEPLSPQKYVTSAPMPEPQAPGRYFAHSILTVSEEEWNTGGTYTCVVAHEALPNRVTERTVDKSTGKPTLYNVSLVMSDTAGTCY

SEQ ID NO: 61 - protein, 353 aa, Homo sapiens
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 62 - protein, 222 aa, Homo sapiens
ADPCDSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 63 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 64 - protein, 15 aa, Artificial Sequence
  Synthetic Sequence
VLVLNPSVAATLGFG

SEQ ID NO: 65 - protein, 15 aa, Artificial Sequence
  Synthetic Sequence
TYGKFLADGGCSGGA

SEQ ID NO: 66 - protein, 15 aa, Artificial Sequence
  Synthetic Sequence
GGRHLIFCHSKKKCD

SEQ ID NO: 67 - protein, 11 aa, Artificial Sequence
  Synthetic Sequence
VAYYRGLDVSV

SEQ ID NO: 68 - protein, 18 aa, Artificial Sequence
  Synthetic Sequence
ATDALMTGFTGDFDSVID

SEQ ID NO: 69 - protein, 15 aa, Artificial Sequence
  Synthetic Sequence
TGLTHIDAHFLSQTK

SEQ ID NO: 70 - protein, 13 aa, Artificial Sequence
  Synthetic Sequence
QYLAGLSTLPGNP

SEQ ID NO: 71 - protein, 8 aa, Artificial Sequence
  Synthetic Sequence
NLLPAILS

SEQ ID NO: 72 - protein, 27 aa, Artificial Sequence
  Synthetic Sequence
RHVGPGEGAVQWMNRLIAFASRGNHVS

SEQ ID NO: 73 - protein, 15 aa, Artificial Sequence
  Synthetic Sequence
SSASQLSAPSLKATC

SEQ ID NO: 74 - protein, 5 aa, Artificial Sequence
  Synthetic Sequence
SNVSV

SEQ ID NO: 75 - protein, 9 aa, Artificial Sequence
  Synthetic Sequence
TYSTYGKFL

SEQ ID NO: 76 - protein, 9 aa, Artificial Sequence
  Synthetic Sequence
LIFCHSKKK

SEQ ID NO: 77 - protein, 16 aa, Artificial Sequence
  Synthetic Sequence
ATDALMTGFTGDFDSV

SEQ ID NO: 78 - protein, 10 aa, Artificial Sequence
  Synthetic Sequence
VLAALAAYCL

SEQ ID NO: 79 - protein, 9 aa, Artificial Sequence
  Synthetic Sequence
ILAGYGAGV

SEQ ID NO: 80 - protein, 8 aa, Artificial Sequence
  Synthetic Sequence
IPFYGKAI

SEQ ID NO: 81 - protein, 9 aa, Artificial Sequence
  Synthetic Sequence
RAQAPPPSW

SEQ ID NO: 82 - protein, 36 aa, Artificial Sequence
  Synthetic Sequence
EGAVQWMNRLIAFASRGNHVSPTHYVPESDAAARVT

SEQ ID NO: 83 - protein, 9 aa, Artificial Sequence
  Synthetic Sequence
RPDYNPPLL

SEQ ID NO: 84 - protein, 9 aa, Artificial Sequence
  Synthetic Sequence
TIMAKNEVF

SEQ ID NO: 85 - protein, 29 aa, Artificial Sequence
  Synthetic Sequence
AIPLEVIKGGRHLIFCHSKKKCDELAAKL

SEQ ID NO: 86 - protein, 50 aa, Artificial Sequence
  Synthetic Sequence
LGALTGTYVYNHLTPLRDWAHNGLRDLAVAVEPVVFSQMETKLITWGADT

SEQ ID NO: 87 - protein, 52 aa, Artificial Sequence
  Synthetic Sequence
AIPLEVIKGGRHLIFCHSKKKCDELAAKLVALGINAVAYYRGLDVSVIPTSG

SEQ ID NO: 88 - protein, 70 aa, Artificial Sequence
  Synthetic Sequence
KGGRHLIFCHSKKKCDELAAKLVALGINAVAYYRGLDVSVIPTSGDVVVVATDALMTGFTGDFDSVIDCN

SEQ ID NO: 89 - protein, 100 aa, Artificial Sequence
  Synthetic Sequence
VALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDF

SEQ ID NO: 90 - protein, 171 aa, Artificial Sequence
  Synthetic Sequence
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPG

SEQ ID NO: 91 - protein, 228 aa, Artificial Sequence
  Synthetic Sequence
LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN

SEQ ID NO: 92 - protein, 553 aa, Artificial Sequence
  Synthetic Sequence
QASLLKVPYFVRVQGLLRICALARKMAGGHYVQMAIIKLGALTGTYVYNALTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN

SEQ ID NO: 93 - protein, 778 aa, Artificial Sequence
  Synthetic Sequence
LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPG

SEQ ID NO: 94 - protein, 1985 aa, Artificial Sequence
  Synthetic Sequence
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSEADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGNNLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNR

SEQ ID NO: 95 - protein, 3012 aa, Artificial Sequence
  Synthetic Sequence
  misc_feature (3012)..(3012): Xaa can be any amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAETHVTGGSAARTTSGLASLFTPGAKQNIQLINTNGSWHINRTALNCNDSLNTGWLAGLFYYHKFNSSGCPERLASCRPLTDFDQGWGPISYANGSGPDQRPYCWHYPPKPCGIVPAKSVCGPVYCFTPSPVVVGTTDRSGAPTYNWGENDTDVFVLNNTRPPLGNWFGCTWMNSTGFTKVCGAPPCVIGGVGNNTLHCPTDCFRKHPEATYSRCGSGPWITPRCLVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVVLNAASLAGTHGLVSFLVFFCFAWYLKGRWVPGAAYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSEADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNRX

SEQ ID NO: 96 - protein, 3014 aa, Artificial sequence
  Synthetic Sequence
  misc_feature (197)..(197): Xaa can be any amino acid
  misc_feature (241)..(241): Xaa can be any amino acid
  misc_feature (251)..(251): Xaa can be any amino acid
  misc_feature (290)..(290): Xaa can be any amino acid
  misc_feature (331)..(331): Xaa can be any amino acid
  misc_feature (334)..(334): Xaa can be any amino acid
  misc_feature (343)..(344): Xaa can be any amino acid
  misc_feature (372)..(372): Xaa can be any amino acid
  misc_feature (390)..(390): Xaa can be any amino acid
  misc_feature (407)..(407): Xaa can be any amino acid
  misc_feature (433)..(433): Xaa can be any amino acid
  misc_feature (476)..(476): Xaa can be any amino acid
  misc_feature (523)..(523): Xaa can be any amino acid
  misc_feature (597)..(597): Xaa can be any amino acid
  misc_feature (715)..(715): Xaa can be any amino acid
  misc_feature (767)..(767): Xaa can be any amino acid
  misc_feature (786)..(786): Xaa can be any amino acid
  misc_feature (792)..(792): Xaa can be any amino acid
  misc_feature (821)..(821): Xaa can be any amino acid
  misc_feature (826)..(826): Xaa can be any amino acid
  misc_feature (843)..(843): Xaa can be any amino acid
  misc_feature (857)..(857): Xaa can be any amino acid
  misc_feature (873)..(874): Xaa can be any amino acid
  misc_feature (884)..(884): Xaa can be any amino acid
  misc_feature (922)..(922): Xaa can be any amino acid
  misc_feature (928)..(928): Xaa can be any amino acid
  misc_feature (955)..(955): Xaa can be any amino acid
  misc_feature (1020)..(1020): Xaa can be any namino acid
  misc_feature (1099)..(1099): Xaa can be any amino acid
  misc_feature (1143)..(1143): Xaa can be any amino acid
  misc_feature (1161)..(1161): Xaa can be any amino acid
  misc_feature (1210)..(1210): Xaa can be any amino acid
  misc_feature (1223)..(1223): Xaa can be any amino acid
  misc_feature (1371)..(1371): Xaa can be any amino acid
  misc_feature (1385)..(1385): Xaa can be any amino acid
  misc_feature (1409)..(1409): Xaa can be any amino acid
  misc_feature (1599)..(1599): Xaa can be any amino acid
  misc_feature (1607)..(1607): Xaa can be any amino acid
  misc_feature (1695)..(1695): Xaa can be any amino acid
  misc_feature (1753)..(1753): Xaa can be any amino acid
  misc_feature (1874)..(1874): Xaa can be any amino acid
  misc_feature (2071)..(2072): Xaa can be any amino acid
  misc_feature (2074)..(2074): Xaa can be any amino acid
  misc_feature (2087)..(2087): Xaa can be any amino acid
  misc_feature (2106)..(2106): Xaa can be any amino acid
  misc_feature (2134)..(2134): Xaa can be any amino acid
  misc_feature (2279)..(2279): Xaa can be any amino acid
  misc_feature (2321)..(2321): Xaa can be any amino acid
  misc_feature (2335)..(2335): Xaa can be any amino acid
  misc_feature (2358)..(2358): Xaa can be any amino acid
  misc_feature (2361)..(2362): Xaa can be any amino acid
  misc_feature (2364)..(2364): Xaa can be any amino acid
  misc_feature (2367)..(2367): Xaa can be any amino acid
  misc_feature (2373)..(2374): Xaa can be any amino acid
  misc_feature (2376)..(2376): Xaa can be any amino acid
  misc_feature (2383)..(2383): Xaa can be any amino acid
  misc_feature (2487)..(2487): Xaa can be any amino acid
  misc_feature (2496)..(2496): Xaa can be any amino acid
  misc_feature (2542)..(2542): Xaa can be any amino acid
  misc_feature (2546)..(2546): Xaa can be any amino acid
  misc_feature (2572)..(2572): Xaa can be any amino acid
  misc_feature (2601)..(2601): Xaa can be any amino acid
  misc_feature (2653)..(2653): Xaa can be any amino acid
  misc_feature (2660)..(2660): Xaa can be any amino acid
  misc_feature (2676)..(2676): Xaa can be any amino acid
  misc_feature (2689)..(2689): Xaa can be any amino acid
  misc_feature (2695)..(2695): Xaa can be any amino acid
  misc_feature (2722)..(2722): Xaa can be any amino acid
  misc_feature (2757)..(2757): Xaa can be any amino acid
  misc_feature (2798)..(2798): Xaa can be any amino acid
  misc_feature (2857)..(2857): Xaa can be any amino acid
  misc_feature (2863)..(2863): Xaa can be any amino acid
  misc_feature (2966)..(2966): Xaa can be any amino acid
  misc_feature (3002)..(3002): Xaa can be any amino acid
  misc_feature (3014)..(3014): Xaa can be any amino acid
MSTNPKPQRKTKRNTNRRPQDVKFPGGGQIVGGVYLLPRRGPRLGVRATRKTSERSQPRGRRQPIPKARRSEGRSWAQPGYPWPLYGNEGCGWAGWLLSPRGSRPSWGPTDPRRRSRNLGKVIDTLTCGFADLMGYIPLVGAPLGGVARALAHGVRVLEDGINYATGNLPGCSFSIFLLALLSCLTVPASAYEVRNXSGLYHVTNDCPNSSIVYEADDAILHTPGCVPCVREGNTSRCWVXVTPTVAVRYXGAPTTSLRRHVDLLVGAATLCSALYVGDLCGAVFLVGQXFTFSPRRHWTVQDCNCSIYPGHITGHRMAWDMMMNWSPTTXLVXAQLLRIPQXXLDIIAGAHWGVLAGLAYFSMQGNWAKVXVLLLFAGVDAETHTTGGXAARTTSGLTSLFSPGPXQNLQLINTNGSWHINRTALNCNDSLXTGFIAGLFYTHKFNSSGCPERLASCRPLTDFDQGWGPLTYANXISGPSDDRPYCWHYPPRPCGIVPARSVCGPVYCFTPSPVVVGTTDRXGVPTYTWGENETDVFLLNSTRPPQGNWFGCTWMNSTGFTKTCGAPPCNIGGGGNNDLLCPTDCFRKHPEATYSXCGSGPWLTPRCLVDYPYRLWHYPCTVNFTIFKVRMYVGGVEHRLEAACNWTRGERCDLEDRDRSELSPLLHSTTEWAILPCSFTTLPALSTGLIHLHQNIVDVQYLYGVGSAVVSWAXKWEYVVLLFLLLADARVCACLWMMLLISQAEAALENLVVLNAASAAGTHGIXWFLVFFCAAWYLKGRLVPXATYALXGLWPLLLLLLALPQRAYALDREVAASLGXAVLVXLTIFTLSPHYKHLLSRXLWWLQYFITRAEAXLQVWVPPLNVRGGRDXXILLTCLLHPXLVFDITKLLLAVLGPLYLLQASLLRVPYFVRAHALLRXCMLVRXLAGGKYVQMALLKLGRWTGTYIYDHLXPLSDWAAAGLRDLAVAVEPVIFSPMEKKVITWGADTAACGDILCGLPVSARLGREILLGPADDYXSKGWRLLAPITAYAQQTRGLLGTIVTSLTGRDKNEVEGEVQVLSTATQTFLGTCINGVMWTVYHGAGSKTLAGPKGPVXQMYTNVDQDLVGWPAPPGAKSLTPCTCGSSDLYLVTRHADVIPXRRRGDSRGSLLSPRPISXLKGSSGGPVLCPSGHAVGIFRAAVCTRGVAKAVDFIPVESLETTMRSPXFTDNSTPPAVPQXYQVGYLHAPTGSGKSTKVPAAYAAQGYKVLVLNPSVAATLGFGAYMSKAHGIDPNIRTGVRTVTTGAPITYSTYGKFLADGGCSGGAYDIIICDECHSTDATTILGIGTVLDQAETAGVRLVVLATATPPGSVTVPHPNIEEVALGTXGEIPFYGKAIPLEXIKGGRHLIFCHSKKKCDELAAKLXGLGLNAVAYYRGLDVSVIPTSGDVVVVATDALMTGFTGDFDSVIDCNVAVTQTVDFSLDPTFTIETTTVPQDAVSRSQRRGRTGRGRLGIYRYVSPGERPSGMFDSVVLCECYDAGCAWYELTPAETTVRLRAYLNTPGLPVCQDHLEFWEGVFTGLTHIDAHFLSQTKQSGENFPYLVAYQATVCARAXAPPPSWDXMWKCLIRLKPTLHGPTPLLYRLGAVQNEVTLTHPITKYIMTCMSADLEVVTSTWVLVGGVLAALAAYCLSTGCVVIVGRIVLSGKPAXIPDREVLYQQFDEMEECSQHLPYIEQGQQIAEQFKQKALGLLQTATKQAEVIAPAVQXNWQKLEQFWAKHMWNFISGIQYLAGLSTLPGNPAVASLMAFTAAVTSPLTTSQTLLFNILGGWVASQLAPPTAATAFVVSGLAGAAVGSIGLGKVLVDILAGYGAGVAGALVAFKIMSGEXPSTEDLVNLLPAILSPGALVVGVVCAAILRRHVGPGEGAVQWMNRLIAFASRGNHVSPTHYVPESDAAARVTQILSSLTVTSLLRRLHQWINEDCSTPCSGSWLRDIWDWVCTVLSDFKTWLKAKLLPQLPGIPFLSCQRGYKGVWRGDGVMHTRCPCGAEITGHVKNGSMRIVGPKTCSNTWHGTFPINAYTTGPXXPXPAPNYKRALWRVXAEEYVEVRRVGDFHYVTGXTTDNLKCPCQVPAPEFFTEVDGVRLHRXAPPCKPLLRDEVTFSVGLNSYVVGSQLPCEPEPDVAVLTSMLTDPSHITAETAARRLARGSPPSLASSSASQLSAPSLKATCTTHHDHPDAELIEANLLWRQEMGGNITRVESENKVVILDSFDPLVAEEDDREISVPAECLRKXRKFPPALPIWARPDYNPPLLETWKRPDYEPPTVHGCALPPPXAPPVPPPRRKRTVXLTESTVSTALAELAEKSFGSSEXSGXXSXSGXDTTSSXXSXPPDCDAXSDAESYSSMPPLEGEPGDPDLSDGSWSTVSDEEDSVVCCSMSYSWTGALITPCAAEEEKLPINPLSNSLLRHHNLVYSTTSRSASQRQKKVTFDRLQVLDDHYXDVLKEVKAXASKVKARLLSVEEACALTPPHSARSKFGYGAKDVRSLSRKAVNHIXSVWXDLLEDSTTPIPTTIMAKNEVFCVDPXKGGRKPARLIVYPDLGVRVCEKRALYDVXQKLPKAVMGSSYGFQYSPAQRVEFLLKAWKSKKTPMGFSYDTRCFDSTVTEXDIRTEEXIYQCCDLDPEARKAIXSLTERLYVGGPMXNSKGQXCGYRRCRASGVLTTSMGNTLTCYIKAXAACRAAGLRDCTMLVCGDDLVVICESAGVZEDAAXLRAFTEAMTRYSAPPGDPPQPEYDLELITSCSSNVSVAHDXSGKRVYYLTRDPTTPLARAAWETARHTPVNSWLGNIIMYAPTIWVRMVLMTHFFSILQXQEQLEXALDFEMYGATYSVTPLDLPAIIQRLHGLSAFSLHSYSPGELNRVAACLRKLGVPPLRAWRHRARAVRAKLIAQGGRAAICGKYLFNWAVRTKLKLTPLPAAGXLDLSSWFTVGAGGGDIYHSVSRARPRWLLLCLLLLXVGVGIFLLPARX

SEQ ID NO: 97 - protein, 3012 aa, Artificial sequence; identical to SEQ ID NO: 95
  Synthetic Sequence
  misc_feature (3012)..(3012): Xaa can be any amino acid

SEQ ID NO: 98 - protein, 3008 aa, Artificial sequence
  Synthetic Sequence
  misc_feature (3008)..(3008): Xaa can be any amino acid
MSTNPKPQRKTKRNTNRRPQDVKFPGGGQIVGGVYLLPRRGPRLGVRATRKTSERSQPRGRRQPIPKARRPEGRAWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVRENNSSRCWVALTPTLAARNASVPTTTIRRHVDLLVGAAAFCSAMYVGDLCGSVFLVSQLFTFSPRRHETVQDCNCSIYPGHVSGHRMAWDMMMNWSPTTALVVSQLLRIPQAVVDMVAGAHWGVLAGLAYYSMVGNWAKVLIVMLLFAGVDGTHVTGGAAARTTSGFTSLFSPGPSQKIQLINTNGSWHINRTALNCNDSLQTGFLAALFYTHKFNSSGCPERMASCRPIDKFAQGWGPITYAEPSSDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCLVDYPYRLWHYPCTVNFTIFKVRMYVGGVEHRLNAACNWTRGERCDLEDRDRSELSPLLLSTTEWQILPCSFTTLPALSTGLIHLHQNIVDVQYLYGIGSAVVSFAIKWEYVLLLFLLLADARVCACLWMMLLIAQAEAALENLVVLNAASVAGAHGILSFLVFFCAAWYIKGRLVPGAAYAFYGVWPLLLLLLALPPRAYAMDREMAASCGGAVFVGLALLTLSPHYKVFLARLIWWLQYFITRAEAHLQVWIPPLNVRGGRDAIILLTCAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIILGLPVSARRGREILLGPADSLEGQGWRLLAPITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGVDPNIRTGVRTITTGAPITYSTYGKFLADGGCSGGAYDIIICDECHSTDSTTILGIGTVLDQAETAGARLVVLATATPPGSVTVPHPNIEEVALSNTGEIPFYGKAIPIETIKGGRHLIFCHSKKKCDELAAKLSGLGLNAVAYYRGLDVSVIPTSGDVVVVATDALMTGFTGDFDSVIDCNTCVTQTVDFSLDPTFTIETTTVPQDAVSRSQRRGRTGRGRRGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTLTHPITKYIMACMSADLEVVTSTWVLVGGVLAALAAYCLTTGSVVIVGRIILSGKPAIIPDREVLYQEFDEMEECASHLPYIEQGMQLAEQFKQKALGLLQTATKQAEAAAPVVESKWRALEFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFLSCQRGYKGVWRGDGIMQTTCPCGAQITGHVKNGSMRIVGPKTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVAVLTSMLTDPSHITAETAKRRLARGSPPSLASSSASQLSAPSLKATCTTRHDSPDADLIEANLLWRQEMGGNITRVESENKVVILDSFDPLRAEEDEREVSVPAEILRKSRKFPPAMPIWARPDYNPPLLESWKDPDYVPPVVHGCPLPPTKAPPIPPPRRKRTVVLTESTVSSALAELATKTFGSSESSAVDSGTATAPPDQPSDDGDAGSDVESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKSKKCPMGFAYDTRCFDSTVTESDIRVEESIYQCCDLAPEARQAIRSLTERLYIGGPLTNSKGQNCGYRRCRASGVLTTSCGNTLTCYLKASAACRAAKLQDCTMLVCGDDLVVICESAGTQEDAASLRVFTEAMTRYSAPPGDPPQPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRAKLLSQGGRAATCGKYLFNWAVRTKLKLTPIPAASQLDLSGWFVAGYSGGDIYHSLSRARPRWFMWCLLLLSVGVGIYLLPNRX

SEQ ID NO: 99 - protein, 3034 aa, Artificial sequence
  Synthetic Sequence
  misc_feature (250)..(250): Xaa can be any amino acid
  misc_feature (406)..(406): Xaa can be any amino acid
  misc_feature (408)..(409): Xaa can be any amino acid
  misc_feature (3023)..(3023): Xaa can be any amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAAQVKNTSSSYMVTNDCSNDSITWQLQAAVLHVPGCVPCEKVGNNTSRCWIPVSPNVAVXQPGALTQGLRTHIDMVVMSATLCSALYVGDLCGGVMLAAQMFIVSPQHHWFVQECNCSIYPGTITGHRMAWDMMMNWSPTATMILAYAMRVPEVIIDIISGAHWGVMFGLAYFSMQGAWAKVVVILLLAAGVDAGTHTVGGSAAHTTSGLAGLFSXGXXQNIQLINTNGSWHINRTALNCNDSLNTGFLASLFYTHRFNSSGCPERLSACRNIEAFRIGWGTLQYEDNVTNPEDMRPYCWHYPPKQCGIVPARSVCGPVYCFTPSPVVVGTTDRLGVPTYTWGENETDVFLLNSTRPPQGSWFGCTWMNSTGFTKTCGAPPCRIRADFNASTDLLCPTDCFRKHPEATYIKCGSGPWLTPRCLVDYPYRLWHYPCTVNYTIFKIRMYVGGVEHRLTAACNFTRGDRCNLEDRDRSQLSPLLHSTTEWAILPCSYSDLPALSTGLLHLHQNIVDVQYMYGLSPALTKYVVRWEWVVLLFLLLADARVCACLWMLILLGQAEAALEKLVVLHAASAASCNGFLYFVIFFVAAWYIKGRAVPLAAYSLTGLWPFCLLLLALPQQAYAYDASVHGQIGAALLILITLFTLTPGYKTLLSRCLWWLCYLLTLGEAMVQEWAPPMQARGGRDGIIWAATIFCPGVVFDITKWLLAVLGPAYLLRDALTRVPYFVRAHALLRMCTMVRHLAGGRYVQMALLALGRWTGTYIYDHLTPMSDWAASGLRDLAVAVEPIIFSPMEKKVIVWGAETAACGDILHGLPVSARLGREILLGPADGYTSKGWRLLAPITAYAQQTRGLLGAIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGIFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGEAITYSTYGKFLADGGCAGGAYDIIICDECHAVDATTILGIGTVLDQAETAGVRLTVLATATPPGSVTTPHPNIEEVALGQEGEIPFYGRAIPLSYIKGGRHLIFCHSKKKCDELAAALRGMGLNAVAYYRGLDVSIIPTQGDVVVVATDALMTGYTGDFDSVIDCNVAVTQVVDFSLDPTFTITTQTVPQDAVSRSQRRGRTGRGRLGIYRYVSTGERASGMFDSVVLCECYDAGAAWYELTPAETTVRLRAYFNTPGLPVCQDHLEFWEAVFTGLTHIDAHFLSQTKQSGENFAYLVAYQATVCARAKAPPPSWDVMWKCLTRLKPTLVGPTPLLYRLGSVTNEVTLTHPVTKYIATCMQADLEVMTSTWVLAGGVLAAVAAYCLATGCVSIIGRLHINQRAVVAPDKEVLYEAFDEMEECASRAALIEEGQRIAEMLKSKIQGLLQQASKQAQDIQPAVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCAGSWLRDVWDWVCTILTDFKNWLTSKLFPKMPGLPFISCQKGYKGVWAGTGIMTTRCPCGANISGNVRLGSMRITGPKTCMNTWQGTFPINCYTEGQCVPKPAPNFKTAIWRVAASEYAEVTQHGSYSYITGLTTDNLKVPCQLPSPEFFSWVDGVQIHRFAPTPKPFFRDEVSFCVGLNSFVVGSQLPCDPEPDTDVLMSMLTDPSHITAEAAARRLARGSPPSEASSSASQLSAPSLRATCTTHGKTYDVDMVDANLFMGGDVTRIESESKVVVLDSLDPMAEERSDLEPSIPSEYMLPRNRFPPALPAWARPDYNPPLVESWKRPDYQPPTVAGCALPPPKKTPTPPPRRRRTVGLSESTIGDALQQLAIKTFGQPPPSGDSGLSTGADAADSGGRTPPDELALSETGSISSMPPLEGEPGDPDLEPEQVELQPPPQGGEVAPGSDSGSWSTCSEEDDSVVCCSMSYSWTGALITPCSPEEEKLPINPLSNSLLRYHNKVYCTTSKSASLRAKKVTFDRMQVLDAHYDSVLKDIKLAASKVSARLLTLEEACQLTPPHSARSKYGFGAKEVRSLSGRAVNHIKSVWKDLLEDSQTPIPTTIMAKNEVFCVDPTKGGKKAARLIVYPDLGVRVCEKMALYDVTQKLPQAVMGASYGFQYSPAQRVEFLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWVRMVLMTHFFSILMAQDTLDQNLNFEMYGSVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGDIYHSVSRARPRLLLLSLLLLXVGVGLFLLPAR

SEQ ID NO: 100 - protein, 3033 aa, Artificial sequence
  Synthetic Sequence
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGKVIDTITCGFADLMGYIPVVGAPVGGVARALAHGVRVLEDGINYATGNLPGCSFSIFLLALLSCVTVPVSAVEVRNISSSYYATNDCSNNSITWQLTNAVLHLPGCVPCENDNGTLRCWIQVTPNVAVKHRGALTHNLRTHVDMIVMAATVCSALYVGDVCGAVMIVSQALIVSPERHNFTQECNCSIYQGHITGHRMAWDMMLNWSPTLTMILAYAARVPELVLEVVFGGHWGVVFGLAYFSMQGAWAKVIAILLLVAGVDATTYSSGAQAGRTTSGFAGLFSPGPKQNIQLINTNGSWHINRTALNCNDSLQTGFIASLFYTNNFNSSGCPERLSSCRGLDDFRIGWGTLEYETNVTNDEDMRPYCWHYPPKPCGIVSARTVCGPVYCFTPSPVVVGTTDRQGVPTYSWGENETDVFLLNSTRPPQGAWFGCTWMNGTGFTKTCGAPPCRIRRDYNSTLDLLCPTDCFRKHPDATYLKCGAGPWLTPRCLVDYPYRLWHYPCTVNFTIFKVRMYVGGVEHRLSAACNFTRGDRCRLEDRDRGQQSPLLHSTTEWAVLPCSFSDLPALSTGLLHLHQNIVDVQYLYGLSPAITRYIVKWEWVVLLFLLLADARVCACLWMLIILGQAEAALEKLIILHSASAASANGPLWFFIFFTAAWYLKGRVVPVATYSVLGLWSFLLLVLALPQQAYALDAAEQGELGLVILVIISIFTLTPAYKILLSRSVWWLSYMLVLAEAQIQQWVPPLEARGGRDGIIWVAVILHPRLVFEVTKWLLAILGPAYLLKASLLRVPYFVRAHALLRVCTLVRHLAGARYIQMLLITIGRWTGTYIYDHLSPLSTWAAQGLRDLAVAVEPVVFSPMEKKVIVWGAETVACGDILHGLPVSARLGREVLLGPADSYTSKGWKLLAPITAYTQQTRGLLGAIVVSLTGRDKNEQAGQVQVLSSVTQSFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCPRGHAVGLFRAAVCARGVAKSIDFIPVESLDIATRTPSFSDNSTPPAVPQSYQVGYLHAPTGSGKSTKVPAAYASQGYKVLVLNPSVAATLGFGAYMSKAHGINPNIRTGVRTVTTGDPITYSTYGKFLADGGCSAGAYDVIICDECHSVDATTILGIGTVLDQAETAGARLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVTQIVDFSLDPTFTITTQTVPQDAVSRSQRRGRTGRGRLGIYRYVSSGERPSGMFDSVVLCECYDAGAAWYELTPAETTVRLRAYFNTPGLPVCQDHLEFWEAVFTGLTHIDAHFLSQTKQGGDNFAYLTAYQATVCARAKAPPPSWDVMWKCLTRLKPTLTGPTPLLYRLGAVTNEVTLTHPVTKYIATCMQADLEIMTSTWVLAGGVLAAVAAYCLATGCISIIGRLHLNDQVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPSVEDVVNLLPAILSPGALVVGVICAAILRRHVGQGEGAVQWMNRLIAFASRGNHVAPTHYVAESDASQRVTQVLSSLTITSLLRRLHAWITEDCPVPCSGSWLRDIWDWVCSILTDFKNWLSSKLLPKMPGLPFISCQKGYRGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPTPGPFFRDEVTFTVGLNSFVVGSQLPCDPEPDTEVLASMLTDPSHITAEAAARRLARGSPPSQASSSASQLSAPSLKATCTTHKMAYDCDMVDANLFMGGDVTRIESDSKVIVLDSLDSMTEVEDDREPSVPSEYLIRRRKFPPALPPWARPDYNPPVIETWKRPGYEPPTVLGCALPPTPQAPVPPPRRRRAKVLTQDNVEGVLREMADKVLSPLQDHNDSGHSTGADTGGDSVQQPSDETAASEAGSLSSMPPLEGEPGDPDLEFEPAGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLSVEEACALTPPHSAKSRYGFGAKEVRSLSRRAVNHIRSVWEDLLEDQHTPIDTTIMAKNEVFCVDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPIMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLDAFSLHTYSPHELSRVAATLRKLGAPPLRAWKSRARAVRASLIAQGGRAAICGRYLFNWAVKTKLKLTPLPEASRLDLSGWFTVGAGGGDIFHSVSHARPRLLLLCLLLLSVGVGIFLLPAR

SEQ ID NO: 101 - protein, 3068 aa, Artificial sequence
  Synthetic Sequence
  misc_feature (385)..(385): Xaa can be any amino acid
  misc_feature (409)..(409): Xaa can be any amino acid
  misc_feature (585)..(585): Xaa can be any amino acid
  misc_feature (3048)..(3048): Xaa can be any amino acid
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQTDGNTSTCWTPVTPTVAVKYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDAXTHTTGGSAARGARGLTSLFSVGPXQNLQLVNTNGSWHINRTALNCNDSINTGFIAGLFYYHKFNSTGCPQRLSSCKPITFFRQGWGPLTDANNITGPSDDKPYCWHYAPRPCDVVPASSVCGPVYCFTPHHSPVVVGTTDAKGVPTYTWGENETDVFLLESLRPPSGRWFGCTWMNSTRGFVKTCGAPPCNIYGGGGNPXNNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEAALENLVTLNAVAAAGTHGIGWYLVAFCAAWHVRRAGKLVPLVTYSLTGLWSLALLVLLLPQRAYAWSGEDSATLGAGILVLFGFFTLSPWYKHWIGRLMWWNQYTICRCEAALQVWVPPLLARGSRDGVILLTSLLYPSLIFDITKLLIAVLGPLYLIQAAITTTPYFVRAHVLVRLCMLVRSVMGGKYFQMIILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGTIVTSLTGRDKNVVTGEVQVLSTATQTFLGTTVGGVMWTVYHGAGSRTLAGAKHPALQMYTNVDQDLVGWPAPPGAKSLEPCACGSADLYLVTRDADVIPARRRGDSTASLLSPRPLACLKGSSGGPVMCPSGHVAGIFRAAVCTRGVAKALQFIPVETLSTQARSPSFSDNSTPPAVPQSYQVGYLHAPTGSGKSTKVPAAYVAQGYNVLVLNPSVAATLGFGSFMSRAYGIDPNIRTGNRTVTTGAKLTYSTYGKFLADGGCSGGAYDVIICDECHAQDATSILGIGTVLDQAETAGVRLTVLATATPPGSITVPHSNIEEVALGSEGEIPFYGKAIPIAQLKGGRHLIFCHSKKKCDEIASKLRGMGLNAVAYYRGLDVSVIPTTGDVVVCATDALMTGFTGDFDSVIDCNVAVEQYVDFSLDPTFSIETRTAPQDAVSRSQRRGRTGRGRLGTYRYVTPGERPSGMFDSVVLCECYDAGCSWYDLQPAETTVRLRAYLSTPGLPVCQDHLDFWESVFTGLTHIDAHFLSQTKQQGLNFSYLTAYQATVCARAQAPPPSWDETWKCLVRLKPTLHGPTPLLYRLGPVQNEICLTHPITKYIMACMSADLEVTTSTWSTWVLLGGVLAALAAYCLSVGCVVIVGHIELGGKPALVPDKEVLYQQYDEMEECSQAAPYIEQAQVIAHQFKEKVLGLLQRATQQQAVIEPIVATNWQKLEAFWHKHMWNFVSGIQYLAGLSTLPGNPAVASLMAFTASVTSPLTTNQTMFFNILGGWVATHLAGPQSSSAFVVSGLAGAAIGGIGLGRVLLDILAGYGAGVSGALVAFKIMGGELPTAEDMVNLLPAILSPGALVVGVICAAILRRHVGPGEGAVQWMNRLIAFASRGNHVSPTHYVPESDAAARVTALLSSLTVTSLLRRLHQWINEDYPSPCSGDWLRTIWDWVCTVLSDFKTWLSAKIMPALPGLPFISCQKGYKGVWRGDGVMSTRCPCGASITGHVKNGSMRLAGPRTCANMWHGTFPINEYTTGPSTPCPSPNYTRALWRVAANSYVEVRRVGDFHYITGATEDELKCPCQVPAAEFFTEVDGVRLHRYAPPCKPLLRDEITFMVGLNSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAETDDAELSVAAECFKKPPKYPPALPIWARPDYNPPLLDRWKAPDYVPPTVHGCALPPRGAPPVPPPRRKRTIQLDGSNVSAALAALAEKSFPSSKPQEENSSSSGVDTQSSTTSKVPPSPGGESDSESCSSMPPLEGEPGDPDLSCDQVELQPPPQGGGVAPGSGSGSWSTVSDSEEQSVVCCSMSYSWTGALITPCSAEEEKLPISPLSNSLLRHHNLVYSTSSRSASQRQKKVTFDRLQVLDDHYKTALKEVKERASRVKARMLTIEEACALVPPHSARSKFGYSAKDVRSLSSKAINQIRSVWEDLLEDTTTPIPTTIMAKNEVFCVDPAKGGRKPARLIVYPDLGVRVCEKRALYDVIQKLSIETMGSAYGFQYSPQQRVERLLKMWTSKKTPLGVLFSYDTRCFDSTVTGEQDIRVEEEIYQCCNLEPEARKVISSLTERLYCGGPMFNSKGAQCGYRRCRASGVLPTSFGNTITCYIKATAAARAAGLRNPDFLVCGDDLVVVAESDGVDEDRAALRAFTEAMTRLWTRYYSAPPGDAPHRPTLQPTYDLELITSCSSNVSVARDNKGKRYYYLTRDATTPLARAAWETARHTPGWGVNSWLGNIIMYAPTIWVRMVMMTHFFSILQSQEILDRPLDFEMYGATYSVTPLDLPAIIERLHGLSAFTLHSYSPVELNRVAGTLRKLGCPPLRAWRHRARAVRAKLIAQGGKAKICGLYLFNWAVRTKTKLTPLPAAGQLDLSSWFTVGVGGNDIYHSVSRARTRXLLLCLLLLTVGVGIFLLPAR

SEQ ID NO: 102 - protein, 3035 aa, Artificial sequence
  Synthetic Sequence
  misc_feature (232)..(232): Xaa can be any amino acid
  misc_feature (397)..(397): Xaa can be any amino acid
  misc_feature (407)..(407): Xaa can be any amino acid
  misc_feature (678)..(678): Xaa can be any amino acid
  misc_feature (1002)..(1002): Xaa can be any amino acid
MSTNPKPQRKTKRNTNRRPMDVKFPGGGQIVGGVYLLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRAVEDGINYATGNLPGCSFSIFLLALLSCLTVPASAINYRNTSGIYHVTNDCPNSSIVYEADHHILHLPGCVPCVRXGNQSRCWVALTPTVAAPYIGAPLESLRSHVDLMVGAATVCSALYIGDLCGGLFLVGQMFSFRPRRHWTTQDCNCSIYTGHITGHRMAWDMMMNWSPTTTLVLAQVMRIPSTLVDLLAGGHWGVLVGVAYFSMQANWAKVILVLFLFAGVDAETHVSGGAAGRTTXGLTSLFSPGXQQNLQLINSNGSWHINRTALNCNDSLNTGFLASLFYTHKFNSSGCPERLASCKSLDSFDQGWGPLGVANNISGPSDDRPYCWHYPPRPCGIVPASSVCGPVYCFTPSPVVVGTTDRLGVPTYTWGENESDVFLLNSTRPPQGAWFGCVWMNSTGFTKACGAPPCEVRTNNGTSTDWPCPTDCFRKHPETTYAKCGSGPWITPRCLIHYPYRLWHYPCTVNFTVFKIRTFIGGIEHRMEAACNWTRGEVCGLEHRDRAELSPLLLSTTTWQXLPCSFTTLPALSTGLIHLHQNIVDVQYLYGVGSAVVSWALKWEYVVLAFLLLADARVSACLWMMFMVSQVEAALSNLININAASAAGTHGFWYAIFFICIAWHVKGRLPAAATYAACGMWPLLLLLLMLPERAYAYDREVAGSLGGAVVVALTILTLSPHYKSWLARGLWWIQYFIARAEALLHVYVPSFDVRGPRDSLIILAVLACPHLVFDITKYLLAILGPLYILQASLLRVPYFVRAHALVKICSLLRGVVYGKYCQMAVLKVGALTGTYIYDHLTPLSDWAAEGLRDLAVALEPVVFTPMEKKVIVWGADTAACGDIIXGLPVSARLGNEILLGPADSETSKGWRLLAPITAYAQQTRGLFSTIITSLTGRDTNENCGEVQVLSTATQSFLGTAVNGVMWTVYHGAGSKTISGPKGPVNQMYTNVDQDLVGWPAPPGVKSLAPCTCGASDLYLVTRHADVVPVRRRGDTRGALLSPRPISTLKGSSGGPLLCPMGHAAGIFRAAVCTRGVAKAVDFVPVESLETTMRSPVFTDNSTPPAVPQTYQVAHLHAPTGSGKSTKVPAAYAAQGYKVLVLNPSVAATLGFGAYMSKAYGIDPNIRSGVRTITTGAPITYSTYGKFLADGGCSGGAYDIIICDECHSTDSTTILGIGTVLDQAETAGVRLVVLATATPPGSVTTPHSNIEEVALPTTGEIPFYGKAIPLELIKGGRHLIFCHSKKKCDELAKQLTSLGLNAVAYYRGLDVSVIPTSGDVVVCATDALMTGFTGDFDSVIDCNTSVIQTVDFSLDPTFSIETTTVPQDAVSRSQRRGRTGRGRLGIYRYVTPGERPSGIFDTSVLCECYDAGCAWYELTPAETTTRLRAYFNTPGLPVCQDHLEFWESVFTGLTQIDGHFLSQTKQSGENFPYLVAYQATVCARALAPPPSWDTMWKCLIRLKPTLHGPTPLLYRLGSVQNEVTLTHPITKYIMACMSADLEVVTSTWVLVGGVLAALAAYCLSVGSVVIVGRVVLSGQPAVIPDREVLYQQFDEMEECSKHLPLVEHGLQLAEQFKQKAVGLLNFAGKQAQEATPVIQSNFAKLEQFWAKHMWNFISGIQYLAGLSTLPGNPAIASLMSFTAAVTSPLTTQQTLLFNILGGWVASQIATPTASTAFVVSGLAGAAVGSVGLGKILVDILAGYGAGVAGAVVTFKIMSGEMPSTEDLVNLLPAILSPGALVVGVVCAAILRRHVGPGEGAVQWMNRLIAFASRGNHVSPTHYVPESDAAARVTQILSSLTVTSLLRRLHKWINEDCSTPCAESWLWEVWDWVCTVLSDFKTWLKAKLLPLMPGIPFLSCQRGYKGEWRGDGVMHTTCPCGAELAGHIKNGSMRITGPKTCSNTWHGTFPINAYTTGPGVPIPAPNYKFALWRVSAEEYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAETASRRLARGSPPSLASSSASQLSAPSLKATCTARHDSPGTDLLEANLLWGSTATRVETDEKVIILDSFEPCVAEPDDDREVSVAAEILRPTKKFPPALPIWARPDYNPPLTETWKQQDYKPPTVHGCALPPSKQPPVPPPRRKRTVQLTESVVSTALAELAAKTFGQSELGSDSGADLTTGPTETTDSGPILVDDASDDGSYSSMPPLEGEPGDPDLTSDQVELQPPPQGGGVAPGSGSGSWSTVSGSEDTVVCCSMSYSWTGALVTPCAAEESKLPISPLSNSLLRHHNMVYATTTRSAVTRQKKVTFDRLQVVDNHYNETLKEIKARASRVKARLLTTEEACDLTPPHSAKSKFGYGAKDVRSHSRKAINHINSVWEDLLEDNNTPIPTTIMAKNEVFAVNPAKGGRKPARLIVYPDLGGVRVCEKRALHDVINQLPKAVMGAAYGFQYSPAQRVEFLLTSWKSKKTPMGFSYDTRCFDSTVTEKDIRTEEEVYQCCDLEPEARKVITALTERLYVGGPMHNSKGDLCGYRRCRASGVYTTSFGNTLTCYLKATAAIKAAGLRDCTMLVCGDDLVVIAESDGVEEDNRALRAFTEAMTRYSAPPGDAPQPAYDLELITSCSSNVSVAHDATGKKVYYLTRDPETPLARAAWETVRHTPVNSWLGNIIVYAPTIWVRMVLMTHFFSILQSQEALEKALDFDMYGVTYSITPLDLPAIIQRLHGLSAFTLHGYSPHELNRVAGSLRKLGVPPLRAWRHRARAVRAKLIAQGGKAKICGIYLFNWAVKTKLKLTPLPAAANLDLSSWFTVGAGGGDIYHSVSRARPRYLLLCLLLLSVGVGIFLLPAR

SEQ ID NO: 103 - protein, 3013 aa, Artificial sequence
  Synthetic Sequence
  misc_feature (178)..(178): Xaa can be any amino acid
  misc_feature (189)..(189): Xaa can be any amino acid
  misc_feature (232)..(232): Xaa can be any amino acid
  misc_feature (251)..(251): Xaa can be any amino acid
  misc_feature (257)..(257): Xaa can be any amino acid
  misc_feature (285)..(285): Xaa can be any amino acid
  misc_feature (297)..(297): Xaa can be any amino acid
  misc_feature (300)..(300): Xaa can be any amino acid
  misc_feature (333)..(333): Xaa can be any amino acid
  misc_feature (365)..(365): Xaa can be any amino acid
  misc_feature (384)..(384): Xaa can be any amino acid
  misc_feature (386)..(386): Xaa can be any amino acid
  misc_feature (391)..(391): Xaa can be any amino acid
  misc_feature (396)..(398): Xaa can be any amino acid
  misc_feature (404)..(404): Xaa can be any amino acid
  misc_feature (442)..(442): Xaa can be any amino acid
  misc_feature (444)..(444): Xaa can be any amino acid
  misc_feature (476)..(476): Xaa can be any amino acid
  misc_feature (502)..(502): Xaa can be any amino acid
  misc_feature (523)..(523): Xaa can be any amino acid
  misc_feature (525)..(525): Xaa can be any amino acid
  misc_feature (529)..(529): Xaa can be any amino acid
  misc_feature (532)..(532): Xaa can be any amino acid
  misc_feature (547)..(547): Xaa can be any amino acid
  misc_feature (723)..(723): Xaa can be any amino acid
  misc_feature (742)..(742): Xaa can be any amino acid
  misc_feature (763)..(763): Xaa can be any amino acid
  misc_feature (773)..(773): Xaa can be any amino acid
  misc_feature (775)..(775): Xaa can be any amino acid
  misc_feature (779)..(779): Xaa can be any amino acid
  misc_feature (794)..(794): Xaa can be any amino acid
  misc_feature (825)..(825): Xaa can be any amino acid
  misc_feature (839)..(839): Xaa can be any amino acid
  misc_feature (844)..(844): Xaa can be any amino acid
  misc_feature (857)..(857): Xaa can be any amino acid
  misc_feature (905)..(905): Xaa can be any amino acid
  misc_feature (908)..(908): Xaa can be any amino acid
  misc_feature (914)..(914): Xaa can be any amino acid
  misc_feature (931)..(931): Xaa can be any amino acid
  misc_feature (1020)..(1021): Xaa can be any amino acid
  misc_feature (1088)..(1088): Xaa can be any amino acid
  misc_feature (1114)..(1114): Xaa can be any amino acid
  misc_feature (1118)..(1118): Xaa can be any amino acid
  misc_feature (1384)..(1384): Xaa can be any amino acid
  misc_feature (1613)..(1613): Xaa can be any amino acid
  misc_feature (1756)..(1756): Xaa can be any amino acid
  misc_feature (2262)..(2262): Xaa can be any amino acid
  misc_feature (2356)..(2356): Xaa can be any amino acid
  misc_feature (2374)..(2374): Xaa can be any amino acid
  misc_feature (2385)..(2385): Xaa can be any amino acid
  misc_feature (2540)..(2540): Xaa can be any amino acid
  misc_feature (2601)..(2601): Xaa can be any amino acid
  misc_feature (2636)..(2636): Xaa can be any amino acid
  misc_feature (2674)..(2674): Xaa can be any amino acid
  misc_feature (2994)..(2994): Xaa can be any amino acid
  misc_feature (3002)..(3002): Xaa can be any amino acid
MSTNPKPQRKTKRNTNRRPQDVKFPGGGQIVGGVYLLPRRGPRLGVRATRKTSERSQPRGRRQPIPKARRPTGRSWGQPGYPWPLYANEGLGWAGWLLSPRGSRPNWGPNDPRRKSRNLGKVIDTLTCGFADLMGYIPLVGGPVGGVARALAHGVRVLEDGINYATGNLPGCSFSIFXLALLSCLTVPXSAVPYRNASGVYHVTNDCPNSSIVYEAENLILHAPGCVPCVRXGNVSRCWVQITPTLSAPSXGAVTAXLRRAVDYLAGGAALCSALYVGDACGAVXLVGQMFTYSPRXHTXVQDCNCSIYSGHITGHRMAWDMMMNWSPTTALXMAQLLRIPQVVIDIIAGAHWGVLFAAAYFASXANWAKVILVLFLFAGVDAXTXTVGGXAGQGXXXLTSFFXPGPQQNLQLINTNGSWHINRTALNCNDSLQTGFIAGLXYXHKFNSSGCPQRMASCRPLAAFDQGWGTISYAXVSGPSDDKPYCWHYPPRPCGVVPARXVCGPVYCFTPSPVVVGTTDRXGXPTYXWGXNETDIFLLNNTRPPXGNWFGCTWMNSTGFVKTCGAPPCNLGPTGNNSLKCPTDCFRKHPDATYTKCGSGPWLTPRCLVHYPYRLWHYPCTVNYTIFKVRMFIGGLEHRLEAACNWTRGERCDLEDRDRAELSPLLHTTTQWAILPCSFTPTPALSTGLIHLHQNIVDTQYLYGLSSSIVSWAVKWEYIVLXFLLLADARICTCLWILLLXCQAEAALENVIVLNAAAAAGXHGFFWGLLVXCXAWHXKGRLVPGATYLCLGXWPLLLLLLLLPQRALALDSSDGGTVGCLVLXILTIFTLTPGYKKXVVLVXWWLQYFIARVEAXIHVWVPPLQVRGGRDAIIMLTCLFHPALGFEVTKILLGILGPLYLLQXSLXKVPYFXRARALLRACLLAKHLVXGKYVQAALLHLGRLTGTYIYDHLAPMKDWAASGLRDLAVATEPIIFSPMETKVITWGADTAACGDILAGLPVSARRGREIFLGPADDIXXAGWRLLAPITAYAQQTRGVLGAIVVSLTGRDKNEAEGEVQVLSTATQTFLGTCINGVMWTVFHGAGXKTLAGPKGPVVQMYTNVDKDLVGWPXPPGXRSLTPCTCGSADLYLVTRHADVIPARRRGDTRASLLSPRPISYLKGSSGGPIMCPSGHVVGVFRAAVCTRGVAKALDFIPVENLETTMRSPVFTDNSTPPAVPHEFQVGHLHAPTGSGKSTKVPAAYAAQGYKVLVLNPSVAATLGFGAYMSRAYGVDPNIRTGVRTVTTGAAITYSTYGKFLADGGCSGGAYDVIICDECHSQDATTILGIGTVLDQAETAGARLVVLATATPPGSVTTPHPNIEEVALPSEGEIPFYGRAIPLXLIKGGRHLIFCHSKKKCDELAKQLTSLGVNAVAYYRGLDVAVIPATGDVVVCSTDALMTGFTGDFDSVIDCNTAVTQTVDFSLDPTFTIETTTVPQDAVSRSQRRGRTGRGRHGIYRYVSSGERPSGIFDSVVLCECYDAGCAWYDLTPAETTVRLRAYLNTPGLPVCQDHLEFWEGVFTGLTNIDAHMLSQTKQGGENFPYLVAYQATVCVRAKAPPPSWDTMWKCMXRLKPTLTGPTPLLYRLGAVQNEITLTHPITKYIMACMSADLEVITSTWVLVGGVVAALAAYCLTVGSVAIVGRIILSGRPAIIPDREVLYQQFDEMEECSASLPYMDEARAIAEQFKEKVLGLIGTAGQKAETLKPAATSMWXKAEQFWAKHMWNFVSGIQYLAGLSTLPGNPAVATLMSFTAAVTSPLTTQQTLLFNILGGWVASQIAPPTAATAFVVSGMAGAAVGSIGLGRVLIDILAGYGAGVAGALVAFKIMCGERPTAEDLVNLLPSILCPGALVVGVICAAVLRRHIGPGEGAVQWMNRLIAFASRGNHVSPTHYVPETDASAKVTQLLSSLTVTSLLKRLHTWIGEDYSTPCDGTWLRAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSYVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKXEEDDREISVSADCFRRGPAFPPALPIWARPGYDPPLLETWKRPDYDPPQVSGCPLPPAGLPPVPPPRRKRKPVELSDSTVSQVLADLADARFKXDTPSIEGQDSAVGTSSQXDSGPEEKRDDXSDAASYSSMPPLEGEPGDPDLSSGSWSTVSDEDSVVCCSMSYSWTGALITPCSAEEEKLPINPLSNTLLRHHNLVYSTSSRSAGLRQKKVTFDRLQVLDDHYREVVDEMKRLASKVKARLLPLEEACGLTPPHSARSKYGYGAKEVRSLDKKALXHIEGVWQDLLDDSDTPLPTTIMAKNEVFAVEPSKGGKKPARLIVYPDLGVRVCEKRALYDXAQKLPTALMGPSYGFQYSPAQRVEFLLKTWKSKKXPMAFSYDTRCFDSTVTEHDIMTEESIYQSCDLQPEARXAIRSLTQRLYCGGPMYNSKGQQCGYRRCRASGVFTTSMGNTMTCYIKALASCRAAKLRDCTLLVCGDDLVAICESQGTHEDEASLRAFTEAMTRYSAPPGDPPVPAYDLELVTSCSSNVSVARDASGNRVYYLTRDPQVPLARAAWETAKHSPVNSWLGNIIMYAPTLWARIVLMTHFFSVLQSQEQLEKALAFEMYGSVYSVTPLDLPAIIQRLHGLSAFSLHSYSPSEINRVASCLRKLGVPPLRAWRHRARAVRAKLIAQGGKAAICGIYLFNWAVKTKRKLTPLADADRLDLSSWFTVGAGGGDIYHSMSRARPRXLLCLLLLXVGVGIFLLPAR

SEQ ID NO: 104 - protein, 3014 aa, Artificial sequence
  Synthetic Sequence
  misc_feature (195)..(195): Xaa can be any amino acid
  misc_feature (237)..(237): Xaa can be any amino acid
  misc_feature (389)..(389): Xaa can be any amino acid
  misc_feature (400)..(400): Xaa can be any amino acid
  misc_feature (403)..(403): Xaa can be any amino acid
  misc_feature (572)..(572): Xaa can be any amino acid
  misc_feature (1877)..(1877): Xaa can be any amino acid
  misc_feature (1944)..(1944): Xaa can be any amino acid
  misc_feature (1967)..(1967): Xaa can be any amino acid
MSTLPKPQRKTKRNTNRRPMDVKFPGGGQIVGGVYLLPRRGPRLGVRATRKTSERSQPRGRRQPIPKARQPTGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASAVHYXNSSGIYHLTNDCPNSSIVYEADAMILHLPGCVPCVRVGNQSXCWVPVSPTLAVPNASTPATGFRRHVDLLVGAAAFCSALYIGDLCGGVFLVGQLFTFRPRRHQTVQDCNCSIYTGHVTGHRMAWDMMMNWSPTATLVLSSILRVPQLLLDIFLGGHWGVLGAVLYYSMVANWAKVLAVLLLFAGVDATTTTGXAAGRTTSGLTXLFXPGAKQNLQLINTNGSWHINRTALNCNDSLQTGFIAGLFYTHKFNSSGCPERMSSCKPLTDFDQGWGPITYANISGPSEDRPYCWHYAPRPCDVVPARTVCGPVYCFTPSPVVVGTTDRRGLPTYTWGENETDVFLLESLRPPTGGWFGCTWMNSTGFVKTCGAPPCNIXPNSSNNSLLCPTDCFRKHPEATYARCGSGPWLTPRCLVDYPYRLWHYPCTVNFTIHKVRMFVGGVEHRFDAACNWTRGERCELDDRDRIEMSPLLFSTTELAILPCSFTTMPALSTGLIHLHQNIVDVQYLYGVSSSVVSWAVKWEYVVLAFLVLADARICACLWLMLLIGQAEAALENLIVLNAASAASTQGWWWGLLFLCCAWYVKGRLVPACTYALLQLWPLLLLVLALPRRAYAYDNEQAASLGALVLLVITIFTLTPAYKQLLVSFLWWNQYFIARAEAMLHVWVPSLRVRGGRDAVILLTCLLHPQLGFEVTKILLALLGPLYLLQYSLLKVPYFVRAHILLRACLLVRRLAGGKYVQACLLRLGAWTGTYIYDHLAPLSDWASDGLRDLAVAVEPVIFSPMEKKVITWGADTAACGDILAGLPVSARRGNLVLLGPADDMKRGGWRLLAPITAYAQQTRGLLGTIVTSLTGRDKNEVEGEVQVVSTATQSFLATSINGVLWTVYHGAGSKTLAGPKGPVCQMYTNVDQDLVGWPAPPGARSLTPCTCGSSDLYLVTRNADVIPARRRGDTRAALLSPRPISTLKGSSGGPILCPSGHVVGLFRAAVCTRGVAKSLDFVPVENMETTMRSPSFTDNSTPPAVPQTYQVGYLHAPTGSGKSTKVPAAYASQGYKVLVLNPSVAATLGFGSYMSKAHGIDPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPLEYIKGGRHLIFCHSKKKCDELAKQLTSLGLNAVAFYRGVDVSVIPTSGDVVVCATDALMTGYTGDFDSVIDCNVAVTQVVDFSLDPTFSIETTTVPQDAVSRSQRRGRTGRGKPGVYRYVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPMLTGPTPLLYRLGAVQNEITTTHPITKYIMTCMSADLEVITSTWVLVGGVLAALAAYCLSVGCVVICGRITTTGKPAVIPDREVLYQQFDEMEECSRHIPYLAEGQQIAEQFKQKVLGLLQTTAKQAEELKPAVHSAWPKLEQFWQKHLWNFVSGIQYLAGLSTLPGNPAVASLMSFSASLTSPLSTSTTLLLNILGGWVASQLAPPTASTAFVVSGLAGAAVGSIGLGRVLVDILAGYGAGVSGALVAFKIMSGETPAXEDMVNLLPALLSPGALVVGVVCAAILRRHVGPAEGATQWMNRLIAFASRGNHVSPTHYVPETDASRXVTTILSSLTITSLLRRLHEWINXDWSTPCATSWLRDIWDWVCTVLSDFKTWLKAKLVPSLPGIPFLSCQRGFRGVWRGDGVCHTTCTCGAVIAGHVKNGTMKISGPRTCSNTWHGTFPINATTTGPSVPIPEPNYKRALWRVSAEDYVEVVRVGDCHYVVGATADNLKCPCQVPAPEFFTEVDGVRLHRYAPPCKPLLRDEVTFSVGLSSYAIGSQLPCEPEPDVTVVTSMLTDPSHITAETAARRLARGSPPSLASSSASQLSAPSLKATCTTHGDHPDAELIEANLLWRQEMGGNITRVESENKVIVLDSFDPLVAEYDDREISVSAECHRPPRPKFPPALPIWARPDYNPPLLETWKAPDYEPPVVSGCALPPPGPPPIPPPRRKKVVHLDESTVSHALAQLAEKSFPESSSDSTSSDSGLSITSSGSPEPTTDDDACSEAGSYSSMPPLEGEPGDPDLSSGSWSTVSEEDSVVCCSMSYSWTGALITPCAAEEEKLPINPLSNSLIRHHNLVYSTTSRSASLRQKKVTFDRVQVLDQHYQDVLKEIKLRASQVQARLLSTEEACDLTPPHSARSKFGYGAKDVRSHASKAINHINSVWEDLLEDNQTPIPTTIMAKNEVFCVDPSKGGRKPARLIVYPDLGVRVCEKRALYDITRKLPVAVMGDAYGFQYSPKQRVDYLLKMWRSKKTPMGFSYDTRCFDSTVTERDIRTEHDIYQSCQLDPEARKAITSLTERLYVGGPMYNSKGQSCGYRRCRASGVLPTSLGNTLTCYLKAQAACRAAGLKDFDMLVCGDDLVVISESAGVQEDAAALRAFTEAMTRYSAPPGDEPQPTYDLELITSCSSNVSVAHDGTGQRYYYLTRDPTTPLARAAWETARHTPVNSWLGNIIMYAPTIWVRMVLMTHFFQILQSQEQLHKALDFDIYGVTYSITPLDLPAIIQRLHGMAAFSLHGYSPGELNRVAACLRKLGAPPLRAWRHRARAVRAKLIAQGGKAAICGKYLFNWAVKTKLKLTPLRGASKLDLSGWFVAGYSGGDIYHSVSRARPRMLLLCLLLLTVGVGIFLLPAR

SEQ ID NO: 105 - protein, 3013 aa, hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVLLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPISAYAQQTRGLISTLVVSLTGRDKNETAGEVQVLSTSTQTFLGTNVGGVMWGPYHGAGTRTVAGRGGPVLQMYTSVSDDLVGWPAPPGSKSLEPCSCGSADLYLVTRNADVLPLRRKGDGTASLLSPRPVSSLKGSSGGPVLCPQSHCVGIFRAAVCTRGVAKAVQFVPIEKMQVAQRSPSFSDNSTPPAVPSTYQVGYLHAPTGSGKSTKVPAAYASQGYKVLVLNPSVAATLGFGAYMSKAYGIDPSVRTGARTVTTGAPITYSTYGKFLADGGCSGGAYDIIICDECHAIDATTVVGIGTVLDQAETSGVRLVVLATATPPGSVTVPHPNIEEVALGNDGEIPFYGKAIPLQHIKGGRHLIFCHSKKKCDELAGKLTSLGLTAVAYYRGLDVSVIPTSGDVVVVATDALMTGFTGDFDSVIDCNVAVTQTVDFSLDPTFTIETTTVPQDSVSRSQRRGRTGRGRLGIYRYVSSGERPSGMFDTSVLCECYDLGCSWYELTPSETTTRLRAYLNCPGLPVCQDHLEFWEGVFTGLTHIDAHFLSQTKQEGQNYAYLTAYQATVCARAKAPPPSWDVQWKCLQRLKPLLVGPTPLLYRLGSVTNEVTFTHPITKYIATCMAADLEVTTSTWVIVGGVLAAVAAYCMSTGSVVVVGRVVLGSNVVTAPDREVLYQHFDEMEECSKAPELLKHAQTIGGMFKDKALAVLDTLKPAAQAAVPIVETNFQKVEKLWNQHMWNFISGIQYLAGLSTLPGNPTVASLMAFTASVTSPLATSTTLLVNILGGWFASQLAPPSAATTFVVSGLAGAAVGSVGLGKVLVDVLAGYGAGIAGALVAFKIMSGEVPSTEDLANLLPAILSPGALVVGVVCAAIIKRHTGTSEGVTQWMNRLIAFASRGNHVSPTHYIQDDDASKRVMGILSSLTITSLIKRVLAWAQTDYSAPCAGSWLREVWDWVCMVLSDFASWLKAKVLPSLPGIPFLSCQKGYKGEWRNDGIMNTKCPCGALIAGHVKNGSMRIVGPKTCRNTWWGTFPINSHTTGPSSPVPSHCYQRALWRVSATEYVEILRHNDQHYVVGVTAEDLKCPCQVPSPEFFSFVDGVRIHRFAPEPKPMIREEAAFVVGLHSYVVGSQLPCEPEPDVQTVSQLLTDPSHITAETAARRLRRGSPPSNASSSASQLSAPSLKATHTTLPQHPDAELIEANLMWEHKVGAIRRMETDTKVIILDSFDSASSVEDDMEPSTAAECLRTRKVFPPAMPIWARPDYNPPVVENWKDPEYAPPQVSGCALPPAQTPPVPPPRRKRAVIQLTESAVSTALAELAERSFPKEEAPPSDSAISLDSPAANDPPSDCDQGSEISFSSMPPLEGEPGDPDLSDGSWSTVSTRSDVICCSMSYSWTGALVTPSGPEEERLPINALSNTMLRHYNMVYSTTSRSASQRAKKVTFDRLQVLDDHYKRALADVKADASTVKAQLLSVEEAAALTPAHSARSKFGYGAKEVRSLAPKAMSHIKEVWKDLLQDMTTPIPTTIMAKNEVFCVNPAKGGKKPARLIVYPDLGVRVCEKRALYDIAQKLPKAIMGQAYGFQYSPSQRVEYLVKTWKSKRTPMGFSYDTRCFDSTVTEQDIRTESEIYQCCNLDPEARTIINALTERLYVGGPMFNSKGQRVGYRRCRASGVFPTSMGNTMTCYIKAKAAAAAAGLESTDFLVCGDDLVVICESKGVERDRADLQAFAAAMTRYSAPPGDMPQPAYDLEHIDSCSSNVSVARDNSGKRVYYLTRDPTNPLSRAAWETARHSPVNSWVGNIIMFAPTIWVRMVLMTHFFALLLNEERLNDPVSFEMYGATYTVCPTDLPDIIQRLHGLRAFELHTYSPAELTRVAATLRKLGVPPLRTWRQRARKVRAGLIGQGGRARICGLYLFNWAVRTKIKLTPLAGAGRLDLSSWFSVCAGEADVDHSTPRAHPRPLLLCLLLLAVGVGIFLLPAR

SEQ ID NO: 106 - protein, 3008 aa, hepatitis C virus
  misc_feature (1871)..(1871): Xaa can be any amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNTSRCWVAMTPTVATRDGKLPTTQLRRHIDLLVGSATLCSALYVGDLCGSVFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDWDVFVLNNTRPPLGNWFGCTWMNSTGFTKVCGAPPCVIGGAGNNTLRCPTDCFRKHPDATYSRCGSGPWITPRCLVDYPYRLWHYPCTVNYSIFKIRMYLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEAALENLVVLNAASLAGTHGLAPFLVFFCLAWYLKGKWAPGAVYAVYGMWPLLLLLLALPQRAYALDTEVAASCGGAVLVGLMVLTLSPHYKHYISWCLWWLQYFLTRAEAQLHVWVPPLNVRGGRDAVILLMCVVHPTLVFDITKLLLAVGPLWILQTSLLKVPYFVRVQGLLRICALARKIAGGHYVQMAIIKLGALTGTYIYDHLTPLRDWAHNGLRDLAVAVEPVVFSRMETKLITWGADTAACGDIINGLPVSARRGQEILLGPADGMVSKGWRLLAPITAYAQQTRGLLGCIITSLTGRDKNQVEGEVQIVSTAAQTFLATCINGVCWTVYHGAGTRTIASPKGPVIQMYTNVDKDLVGWPAPPGSRSLTPCTCGSSDLYLVTRHADVIPVRRRGDSRGSLLSPRPISYLKGSSGGPLLCPAGHAVGIFRAAVCTRGVAKAVDFIPVESLETTMRSPVFTDNSSPPVVPQSFQVAHLHAPTGSGKSTKVPAAYAAQGYKVLVLNPSVAATLFGAYMSKAHGVDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLIRLKPTLHGPTPLLYRLGAVQNEVVLTHPITKYIMTCMSADLEVVTSTWVLVGGVLAALAAYCLSTGCVVIVGRVVLSGKPAIIPDREVLYQEFDEMEECSQHLPYIEQGMMLAEQFKQKALGLLQTASRQAEVIAPAVQTNWQKLEAFWAKHMWNFISGIQYLAGLSTLPGTPAIASLMAFTAAVTSPLTTSQTLLFNILGGWVAAQLAAPGAATAFVGAGLAGAAIGSVGLGKVLVDILAGYGAGVAGALVAFKIMSGEXPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRQVGDFHYVTGMTTDDLKCPCQVPSPEFFTELDGVRLHRFAPPCKPLLREEVSFRVGLHAYPVGSQLPCEPEPDVAVLTSMLTDPSHITAETARRLARGSPPSVASSSASQLSAPSLKATCTANHDSPDAELIEANLLWRQEMGGNITRVESENKVVILDSFDPLVAEEDEREISVPAEILRKSRRFTQALPVWARPDYNPPLVEAWKKPDYEPPVVHGCPLPPPKSPPVPPPRKKRTVVLTESTLSTALAELATKSFGSSSTSGITGDNTTTSSEPAPPGCSPDSDAESCSSMPPLEGEPGDPDLSDGSWSTVSSEADTEDVVCCSMSYTWTGALITPCAAEEQKLPINALSNSLLRHHNLVYSTTSRSACQRQKKVTFDRLQVLDNHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGDSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKAKAACRAAGLQNCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMVLMTHFFSVLIARDQLEQALDCEIYGACYSIEPLDLPPIIQRLHGLSAFSLHSYSPGEINRVAACLRKLGVPPLRTWRHRARSVRAKLLSRGGRAAICGKYLFNWAVRTKLKLTPIAAAGRLDLSGWFTAGYSGGDIYHSVSHARPRWFWFCLLLLAAGVGIYLLPNR

SEQ ID NO: 107 - protein, 3021 aa, hepatitis C virus
MSTLPKPQRKTKRNTIRRPQDVKFPGGGQIVGGVYVLPRRGPRLGVRATRKTSERSQPRERRQPIPKARRSDGRSWAQPGYPWPLYGNEGCGWAGWLLSPRGSRPSWGPNDPRRRSRNLGKVIDTLTCGFADLMGYIPIVGAPVGGVARALAHGVRALEDGINFATGNLPGCSFSIFLLALLSCLIHPAASLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETHTTGGTAARNAFTLTGLFTQGARQKLQLINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESDLFCPTDCFRKHPEATYSRCGAGPWLTPRCLVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGVVGWALRWEFVVLVFLLLADARVCVALWLMLMISQAEAALENLVTLNAVAAAGTHGIGWYLVAFCAAWHLRGKLVPLVTYSLTGLWSLAVLVLLLPQRAYAWSGEDSATLGAGILVLFGFFTLSPWYKHWIGRLMWWNQYTICRCEAALQVWVPPLLARGSRDGAILLTSLLYPSLIFDITKLLIAVLGPLYLIQAAITTTPYFVRAHVLVRLCMLVRSVMGGKYFQMIILSIGRWFNTYLYDHLAPMQHWAAAGLKDLAVATEPVIFSPMEIKVITWGADTAACGDILCGLPVSARLGHEVLLGPADDYREMGWRLLAPITAYAQQTRGLLGTIVTSLTGRDKNVVTGEVQVLSTATQTFLGTTIGGVMWTVYHGAGSRTLAGVKHPALQMYTNVDQDLVGWPAPPGAKSLEPCSCGSTDLYLVTREADVIPARRRGDSTASLLSPRPLACLKGSSGGPVMCPSGHVAGIFRAAVCTRGVAKALQFIPVETLSAQARSPSFSDNSTPPIVPQSYQVGYLHAPTGSGKSTKVPAAYVAQGYNVLVLNPSVAATLGFGSFMSRAYGIDPNIRTGNRTVTTGAKLTYSTYGKFLADGGCSGGAYDVIICDECHAQDATSILGIGTVLDQAETAGVRLTVLATATPPGSITVPHSNIEEVALGSEGEIPFYGKAIPLAQLKGGRHLIFCHSKKKCDEMASKLRGMGLNAVAYYRGLDVSVIPTAGDVVVCATDALMTGFTGDFDSVIDCNVTVEQYVDFSLDPTFSIETRTAPQDAVSRSQRRGRTGRGRLGTYRYVAPGERPSGMFDSVVLCECYDAGCSWYDLQPAETTVRLRAYLSTPGLPVCQDHLDFWESVFTGLTHIDAHFLSQTKQQGLNFSYLTAYQATVCARAQAPPPSWDEMWKCLLRLKPTLHGPTPLLYRLGPVQNETCLTHPVTKYIMACMSADLEVTTSTWVLLGGVLAALAAYCLSVGCVVIVGHIELGGKPALIPDKEVLYQQYDEMEECSQAAPYVEQAQAIAHQFKEKLLGLLQRATQQQAVIEPIVATNWQKLEAFWHKHMWNFVSGIQYLAGLSTLPGNPAVASLMAFTASVTSPLTTNQTMFFNILGGWVATHLAGPQSSSAFVVSGLAGAAIGGIGLGRVLLDILAGYGAGVSGALVAFKIMGGEIPTAEDMVNLLPAILSPGALVVGVICAAILRRHVGPGEGAVQWMNRLIAFASRGNHVSPTHYVPESDAAARVTALLSSLTVTSLLRRLHHWINEDYPSPCSGDWLRTIWDWVCMVLSDFRTWLSAKIMPALPGLPFLSCQKGYKGVWRGDGVVSTRCPCGASITGHVKNGSMRLAGPRTCANMWHGTFPINEYTTGPSTPCPSPNYTRALWRVAANSYVEVRQVGDFHYITGATEDGLKCPCQVPAAEFFTEVDGVRLHRYAPPCKPLLRDEITFMVGLNSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKTPDYVPPTVHGCALPPRGAPPVPPPRRKRTVQLDGSNVSAALAALAEKSFPSLEPQGENSSSSGIDIQSSTASEVPPSPEGESDSESCTSMPPLEGEPGDPDLSCDSWSTVSDSEEQSVVCCSMSYSWTGALITPCSAEEEKLPISPLSNSLLRHHNLVYSTSSRSASQRQKKVTFDRLQVLDDHYKAVLKEVKERASRVKARMLTIEEACALVPPHSARSKFGYSAKDVRSLSGRAVNQIRSVWEDLLEDTTTPIPTTIMAKNEVFCVDPSKGGRKPARLIVYPDLGVRVCEKRALYDVIQKLSIATMGSAYGFQYSPQQRVERLLEMWTSKKTPMGFSYDTRCFDSTVTEQDIRVEEEIYQCCNLEPEARKVISSLTERLYCGGPMFNSKGAQCGYRRCRASGVLPTSFGNTITCYIKATAAARAAGLRNPDFLVCGDDLVLVAESDGVDEDRAALRAFTEAMTRYSAPPGDAPQPTYDLELITSCSSNVSVARDNKGKRYYYLTRDATTPLARAAWETARHTPVNSWLGNIIMYAPTIWVRMVMMTHFFSILQSQEILDRPLDFEMYGATYSVTPLDLPAIIERLHGLSAFTLHSYSPVELNRVAGTLRKLGCPPLRAWRHRARAVRAKLIAQGGKAKICGLYLFNWAVRTKTNLTPLPAAGQLDLSSWFTVGVGGNDIYHSVSRARTRHLLLCLLLLTVGVGIFLLPAR

SEQ ID NO: 108 - protein, 5 aa, Artificial Sequence
  Synthetic Sequence
  Misc_feature (1)..(5): This stretch of residues may be repeated
GSGGS

SEQ ID NO: 109 - protein, 6 aa, Artificial Sequence
  Synthetic Sequence
  Misc_feature (1)..(6): This stretch of residues may be repeated
GGSGGS

SEQ ID NO: 110 - protein, 4 aa, Artificial Sequence
  Synthetic Sequence
  Misc_feature (1)..(4): This stretch of residues may be repeated
GGGS

SEQ ID NO: 111 - protein, 4 aa, Artificial Sequence
  Synthetic Sequence
GGSG

SEQ ID NO: 112 - protein, 5 aa, Artificial Sequence
  Synthetic Sequence
GGSGG

SEQ ID NO: 113 - protein, 5 aa, Artificial Sequence
  Synthetic Sequence
GSGSG

SEQ ID NO: 114 - protein, 5 aa, Artificial Sequence
  Synthetic Sequence
GSGGG

SEQ ID NO: 115 - protein, 5 aa, Artificial Sequence
  Synthetic Sequence
GGGSG

SEQ ID NO: 116 - protein, 5 aa, Artificial Sequence
  Synthetic Sequence
GSSSG

SEQ ID NO: 117 - protein, 8 aa, Artificial Sequence
  Synthetic Sequence
LEVLFQGP

SEQ ID NO: 118 - protein, 7 aa, Artificial Sequence
  Synthetic Sequence
ENLYFQS

SEQ ID NO: 119 - protein, 7 aa, Artificial Sequence
  Synthetic Sequence
ENLYFQG

SEQ ID NO: 120 - protein, 6 aa, Artificial Sequence
  Synthetic Sequence
LVPRGS

SEQ ID NO: 121 - protein, 5 aa, Artificial Sequence
  Synthetic Sequence
  Misc_feature (2)..(2): X is E or D
  Misc_feature (5)..(5): X can be any amino acid except for arginine or proline
IXGRX

SEQ ID NO: 122 - protein, 6 aa, Artificial Sequence
  Synthetic Sequence
LEVLFQ

SEQ ID NO: 123 - protein, 5 aa, Artificial Sequence
  Synthetic Sequence
DDDDK

SEQ ID NO: 124 - protein, 4 aa, Artificial Sequence
  Synthetic Sequence
LVPR

SEQ ID NO: 125 - protein, 4 aa, Artificial Sequence
  Synthetic Sequence
  Misc_feature (2)..(2): X is E or D
IXGR

SEQ ID NO: 126 - protein, 8 aa, Artificial Sequence
  Synthetic Sequence
DYKDDDDK

SEQ ID NO: 127 - protein, 9 aa, Artificial Sequence
  Synthetic Sequence
YPYDVPDYA

SEQ ID NO: 128 - protein, 10 aa, Artificial Sequence
  Synthetic Sequence
EQKLISEEDL

SEQ ID NO: 129 - protein, 191 aa, Artificial Sequence
  Synthetic Sequence
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASA

SEQ ID NO: 130 - protein, 14 aa, Artificial Sequence
  Synthetic Sequence
QYIKANSKFIGIFE

SEQ ID NO: 131 - protein, 14 aa, Artificial Sequence
  Synthetic Sequence
QYIKANSKFIGITE

SEQ ID NO: 132 - protein, 124 aa, Artificial Sequence
  Synthetic Sequence
MIKLKFGVFFTVLLSSAYAHGTPQNITDLCAEYHNTQIHTLNDKIFSYTESLAGKREMAIITFKNGATFQVEVPGSQHIDSQKKAIERMKDTLRIAYLTEAKVEKLCVWNNKTPHAIAAISMAN

SEQ ID NO: 133 - protein, 15 aa, Artificial Sequence
  Synthetic Sequence
ILMQYIKANSKFIGI

SEQ ID NO: 134 - protein, 7 aa, Artificial Sequence
  Synthetic Sequence
VNNESSE

SEQ ID NO: 135 - protein, 17 aa, Artificial Sequence
  Synthetic Sequence
PGINGKAIHLVNNESSE

SEQ ID NO: 136 - protein, 6 aa, Artificial Sequence
  Synthetic Sequence
PNRDIL

SEQ ID NO: 137 - protein, 7 aa, Artificial Sequence
  Synthetic Sequence
FIGITEL

SEQ ID NO: 138 - protein, 6 aa, Artificial Sequence
  Synthetic Sequence
SYFPSV

SEQ ID NO: 139 - protein, 20 aa, Artificial Sequence
  Synthetic Sequence
NSVDDALINSTKIYSYFPSV

SEQ ID NO: 140 - protein, 20 aa, Artificial Sequence
  Synthetic Sequence
IDKISDVSTIVPYIGPALNI

SEQ ID NO: 141 - protein, 15 aa, Artificial Sequence
  Synthetic Sequence
QSIALSSLMVAQAIP

SEQ ID NO: 142 - protein, 19 aa, Artificial Sequence
  Synthetic Sequence
PVFAGANYAAWAVNVAQVI

SEQ ID NO: 143 - protein, 20 aa, Artificial Sequence
  Synthetic Sequence
VHHNTEEIVAQSIALSSLMV

SEQ ID NO: 144 - protein, 20 aa, Artificial Sequence
  Synthetic Sequence
QSIALSSLMVAQAIPLVGEL

SEQ ID NO: 145 - protein, 20 aa, Artificial Sequence
  Synthetic Sequence
VDIGFAAYNFVESIINLFQV

SEQ ID NO: 146 - protein, 20 aa, Artificial Sequence
  Synthetic Sequence
QGESGHDIKITAENTPLPIA

SEQ ID NO: 147 - protein, 20 aa, Artificial Sequence
  Synthetic Sequence
GVLLPTIPGKLDVNKSKTHI

SEQ ID NO: 148 - protein, 534 aa, Artificial Sequence
  Synthetic Sequence
ADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 149 - protein, 26 aa, Artificial sequence
  Synthetic Sequence
IMQYIKANSKFIGIQSIALSSLMVAQ

SEQ ID NO: 150 - protein, 7 aa, Artificial Sequence
  Synethetic Sequence
ENLYYFQ

SEQ ID NO: 151 - protein, 7 aa, Artificial Sequence
  Synthetic Sequence
ENLYYFQ

What is claimed is:

1. An immunogenic composition comprising:
   a) a hepatitis C virus (HCV) E1 polypeptide, an HCV E2 polypeptide, or an HCV E1/E2 heterodimer; and
   b) a cyclic dinucleotide (CDN).

2. The immunogenic composition of claim 1, wherein the CDN is fluorinated.

3. The immunogenic composition of claim 2, wherein the CDN is 2'-F-c-di-GMP.

4. The immunogenic composition of claim 1, wherein the CDN is of Formula (I):

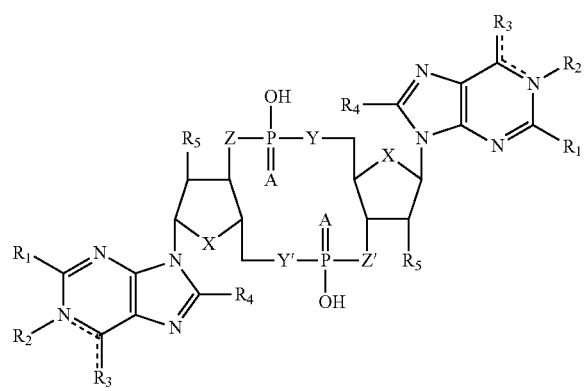

wherein:
A is S or O;
X is S, N, O, $CH_2$;
Y, Y' is NH, $CH_2$, O;
Z, Z' is NH, $CH_2$, O;
R1 represents hydrogen or $NH_2$ which may be substituted;
R2 is hydrogen or absent;
R3 represents $NH_2$, O, OH, H, or a halogen;
R4 represents hydrogen, halogen, or a straight or branched $C_1$-$C_6$ alkyl group which may optionally be substituted;
R5 represents hydrogen, OH or a straight or branched $C_1$-$C_6$ alkyl chain or $C_1$-$C_6$ straight or branched alkoxy chain which may optionally be substituted;
═ is a single or double bond;
or conjugates thereof, and salts or solvates thereof.

5. The immunogenic composition of claim 4, wherein the CDN is c-diGMP, c-diAMP, c-diIMP, c-dXMP, c-GpAp, c-GpIp, c-GpXp, c-ApIp, or c-IpXp.

6. The immunogenic composition of claim 1, wherein the CDN is cyclic-GMP-AMP (cGAMP).

7. The immunogenic composition of claim 6, wherein the cGAMP is 2'3'-cGAMP, 2'2-cGAMP, 3'2'-cGAMP or 3'3'-GAMP.

8. The immunogenic composition of claim 1, wherein the HCV E1 polypeptide, the HCV E2 polypeptide, or one or both chains of the HCV E1/E2 heterodimer comprises a covalently linked T-cell epitope polypeptide comprising a T-cell epitope present in an HCV protein other than E1 and E2.

9. The immunogenic composition of claim 1, comprising a T-cell epitope polypeptide comprising a T-cell epitope present in an HCV protein other than E1 and E2, wherein the T-cell epitope polypeptide is not covalently linked to the HCV E1E2 heterodimer, the HCV E1 polypeptide, or the HCV E2 polypeptide.

10. The immunogenic composition of claim 8, wherein the T-cell epitope polypeptide comprises an amino acid sequence having at least 20% amino acid sequence identity to the amino acid sequence of one of TP29 (SEQ ID NO: 85), TP50 (SEQ ID NO: 86), TP52 (SEQ ID NO: 87), TP70 (SEQ ID NO: 88), TP100 (SEQ ID NO: 89), TP171 (SEQ ID NO: 90), TP228 (SEQ ID NO: 91), TP553 (SEQ ID NO: 92), TP778 (SEQ ID NO: 93), and TP1985 (SEQ ID NO: 94).

11. A method of inducing an immune response to HCV in an individual, the method comprising administering to the individual an effective amount of the immunogenic composition of claim 1.

12. The method of claim 11, wherein said administering is via intramuscular administration, intranasal administration, subcutaneous administration, or a combination thereof.

13. The method of claim 11, wherein said administering comprises a prime and a boost.

14. An immunogenic composition comprising:
   a) one or more nucleic acids comprising nucleotide sequences encoding a hepatitis C virus (HCV) E1 polypeptide, an HCV E2 polypeptide, or an HCV E1/E2 heterodimer; and
   b) a cyclic dinucleotide.

15. A method of inducing an immune response to HCV in an individual, the method comprising administering to the individual an effective amount of the composition of claim 14.

16. An immunogenic composition comprising:
   a) a hepatitis C virus (HCV) E1 polypeptide, an HCV E2 polypeptide, or an HCV E1/E2 heterodimer, or one or more nucleic acids comprising nucleotide sequences encoding the HCV E1 polypeptide, the HCV E2 polypeptide, or the HCV E1/E2 heterodimer; and
   b) an archaeosome comprising at least one polar synthetic lipid, wherein the at least one polar synthetic lipid comprises at least one carbohydrate or anionic group linked by covalent bonding to at least one free hydroxyl group of an archaeal core lipid.

17. The immunogenic composition of claim 16, wherein the archaeal core lipid is archaeol (2,3-di-O-diphytanyl-sn-glycerol) or caldarchaeol (2,2',3,3'-tetra-O-dibiphytanyl-sn-diglycerol).

18. A method of inducing an immune response to HCV in an individual, the method comprising administering to the individual an effective amount of the immunogenic composition of claim 16.

* * * * *